United States Patent 12,508,308 (INFLUENZA mRNA VACCINES) - sequence listing, part 9

SEQ ID NO: 38299 - RNA, 1698 nt, Artificial Sequence
  hemagglutinin__InfluenzaA__AET50441
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccacccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguaaccaaaaggcccucuaucauacagaaaaugcuuaugucucuguagugucuucacauuauagcagaaaauucaccccagaaauagccaaaagacccaaaguaagaggucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuuacaguguagaauaugcaucuaa

SEQ ID NO: 38300 - RNA, 1698 nt, Artificial Sequence
  hemagglutinin__InfluenzaA__AET50442
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaauauguuacccagggcauuucgcugacuaugaggaacugagggagcaauugaguucaguaucuucauuugagagguucgaaauauuccccaaagaaagcucauggcccacccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguaaccaaaaggcccucuaucauacagaaaaugcuuaugucucuguagugucuucacauuauagcagaaaauucaccccagaaauagccaaaagacccaaaguaagaggucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuuacaguguagaauaugcaucuaa

SEQ ID NO: 38301 - RNA, 1698 nt, Artificial Sequence
  hemagglutinin__InfluenzaA__AET84163
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaaucacugauuuccaaagagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaaguaaucaaaagacccucuaucauacagaaaaugcuuauguuucuguagugucuucacauuauagcagaaaauucaccccagaaguagccaaaagacccaaaguaagagaucaagaaggaagaaucaacuacuacuggacucugcuugaacccggggauacaauaauauuugaggcaaauggaaaucuaauagcgccaagguaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagacgguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuga

SEQ ID NO: 38302 - RNA, 1698 nt, Artificial Sequence
  hemagglutinin__InfluenzaA__AET84174
augaaaguaaaacuacugguccuguuaugcacauuuacagcuacauaugcggacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccuuuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugauuagaggcuuuggaucaggaaucaucaacucaaaugcaccaauggguaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38303 - RNA, 1698 nt, Artificial Sequence
  hemagglutinin__InfluenzaA__AET84196
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaaucacugauuuccaaagagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacgaggaagaaugguuuguacccaacccugagcaaguccuaugcaaacaacaaagaaaaagaaguccuuguacuaugggguguucaucacccgccaagcauaaaugaccaaaagacccucuaucauacagaaaaugcuuauguuucuguagugucuucacacuauagcaggaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaagugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaacgcagaacuguugguucuacuggaaaaugaaaggacuuuggauuuccauaacuccaaugugaagaaucuguaugagaaaguaaaaagccaguuaaagaauaaugcuaaagaaauaggaaacggguguuuugaauucuaucacaaguguaacgaugaaugcauggagaguguaaagaauggaacuuaugacuauccaaaauauuccgaagaaucaaaguuaaacagagagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38304 - RNA, 1698 nt, Artificial Sequence
  hemagglutinin__InfluenzaA__AET84207
augaaaguaaaacuacugguccuguuaugcacauuuacagcuacauaugcggacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaccuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaaaugaucaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccagggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuugaauaaaaaaguugaugauggguuuauagacauuuggacauauaaugcagaacuguugguucuacuagaaaaugaaaggacuuuggauuuccaugacuccaaugugaagaaucuguaugagaaaguaaaaagccaguuaaagaauaaugcuaaagaaauaggaaacggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 38305 - RNA, 1698 nt, Artificial Sequence
  hemagglutinin__InfluenzaA__AET84218
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguuugaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaaguaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaguggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucgaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38306 - RNA, 1698 nt, Artificial Sequence
  hemagglutinin__InfluenzaA__AET84229
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaacccugagcaaguccuaugcaaacaacaaagaaaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccacccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38307 - RNA, 1698 nt, Artificial Sequence
  hemagglutinin__InfluenzaA__AET84240
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccaggguauuucgcugacuaugaggagcugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaaaugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacaaugaaugcauggagaguguaaagaauggaacuuaugacuauccaaaauauuccgaagaaucaaaguuaaacagggagaaaauugauggagugaaauuggagucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38308 - RNA, 1698 nt, Artificial Sequence
  hemagglutinin__InfluenzaA__AET84251
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggagcugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguuaaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugucaaacaccucauggagcuauaaacagcugucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaauuuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacaaggagaaaauugauggggugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38309 - RNA, 1698 nt, Artificial Sequence
  hemagglutinin__InfluenzaA__AET84262
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggagcugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucauggagcuauaaacagcugucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38310 - RNA, 1698 nt, Artificial Sequence
  hemagglutinin__InfluenzaA__AET84284
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccaggacauuucgcugacuaugaggaacugagggagcaauugaguucaguaucuucauuugagagguucgaaauauuccccaaagaaagcucauggcccaaccacacuguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcuaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38311 - RNA, 1698 nt, Artificial Sequence
  hemagglutinin__InfluenzaA__AET84306
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccuaacauagguaaccaaaaggcccucuaucauacagaaaaugcuuauguuucuguagugucuucacauuauagcauaaaauucaccccagaaauagccaaaagacccaaaguaagagaucaagaaggaagaaucaacuacuacuggacucugcucgaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaauaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucaaauucuggcgaucuacucaacagucgccaguucucugguucuuuuggucucccugggggcaaucagcuucuggauguguuccaaugggucuuugcaguguagaauaugcaucuaa

SEQ ID NO: 38312 - RNA, 1698 nt, Artificial Sequence
  hemagglutinin__InfluenzaA__AET84339
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagaaguuuuuacagaaauuugcuauggcugacggggaagaaugguuuguacccaaaccugagcaaguccuaugcaaacaacaaagaaaaagaaguccuuguacuaugggguguucaucacccgccuaacauagguaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccaucaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugauuccaaugugaagaaucuguaugagaaaguaaaaagccaguuaaagaauaaugcuaaagaaauaggaaauggguguuuugaauucuaucacaaguguaacgaugagugcauggagaguguaaagaauggaacuuaugacuauccaaaauauuccgaagaaucaaaguuaaacagggagaaaauugauggagugaaguuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38313 - RNA, 1698 nt, Artificial Sequence
  hemagglutinin__InfluenzaA__AET84361
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagaaguuuuuacagaaauuugcuauggcugacggggaagaaugguuuguacccaaaccugagcaaguccuaugcaaacaacaaagaaaaagaaguccuuguacuaugggguguucaucacccgccuaacauagguaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugccuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugagugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38314 - RNA, 1698 nt, Artificial Sequence
  hemagglutinin__InfluenzaA__AET84372
augaaaguaaaacuacugguccuguuaugcacauuuacugcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagaaguuuuuacagaaauuugcuauggcugacggggaagaaugguuuguacccaaaccugagcaaguccuaugcaaacaacaaagaaaaagaaguccuuguacuaugggguguucaucacccgccuaacauaggugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccaucaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugauuccaaugugaagaaucuguaugagaaaguaaaaagccaguuaaagaauaaugcuaaagaaauaggaaauggguguuuugaauucuaucacaaguguaacgaugagugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38315 - RNA, 1698 nt, Artificial Sequence
  hemagglutinin__InfluenzaA__AET84394
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagaaguuuuuacagaaauuugcuauggcugacggggaagaaugguuuguacccaaaccugagcaaguccuaugcaaacaacaaagaaaaagaaguccuuguacuaugggguguucaucacccgccagacauagguaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugccuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugaaaaauuaaggaugguuacaggacuaaggaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugagugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38316 - RNA, 1698 nt, Artificial Sequence
  hemagglutinin__InfluenzaA__AET84405
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaacugcagcguugccggguggaucuuaggaaacccagaaugcgaauuacugauuuccaaggagucaugguccuacauuguagaaaaaccaaauccugaaaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagaaguuuuuacagaaauuugcuauggcugacggggaagaaugguuuguacccaaaccugagcaaguccuaugcaaacaacaaagaaaaagaaguccuuguacuaugggguguucaucacccgccagacauagguaaccaaaagacccucuaucauacagaaaaugcuuauguuucuguagugucuucacacuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccaucaaugggauuacaaacaaggugaauucuguaauugagaaaaugaacacucaauucacagcagugggcaaagaauucaacaaauuggaaagacggauggaaaacuugaauaaaaaaguugaugauggguuuauagacauuuggacauauaaugcagaacuguugguucuacuggaaaaugaaaggacuuuggauuuccaugauuccaaugugaagaaucuguaugagaaaguaaaaagccaguuaaagaauaaugcuaaagaaauaggaaauggguguuuugaauucuaucacaaguguaacgaugagugcauggagaguguaaagaauggaacuuaugacuauccaaaauauuccgaagaaucaaaguuaaacagggagaaaauugauggagugaaauuggaaucaaugggagucuaucagauucuggcgaucuacucaacugucgccaguucucugguucuuuuggucucccugggggcaaucagcuucuggauguguuccaaugggucuuugcaguguagaauaugcaucuaa

SEQ ID NO: 38317 - RNA, 1698 nt, Artificial Sequence
  hemagglutinin__InfluenzaA__AET84416
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaggaguuuuuacagaaauuugcuauggcugacggggaagaaugguuuguacccaacccugagcaaguccuaugcaaacaacaaagaaaaagaaguccuuguacuaugggguguucaucacccgccagacauaggugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccaucaaugggauuacaaacaaggugaauucuguaauugagaaaaugaacacucaauucacagcugugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugauuccaaugugaagaaucuguaugagaaaguaaaaagccaguuaaagaauaaugcuaaagaaauaggaaauggguguuuugaauucuaucacaaguguaacgaugagugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38318 - RNA, 1698 nt, Artificial Sequence
  hemagglutinin__InfluenzaA__AET84427
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcgucgccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaggaaaaagaaguccuuguacuaugggguguucaucacccgccaaacauagguaaccaaaagacccucuaucauacagaaaaugcuuauguuucuguagugucuucacauuauagcagaaaauucaccccagaaauagccaaaagacccaaaguaagagaucaagaaggaaggaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggggccauugccgguuucauugaagggggguggacagggaugguagauggaugguacgguuaucaccaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38319 - RNA, 1698 nt, Artificial Sequence
  hemagglutinin__InfluenzaA__AET84438
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaccacccgccuaacauagguguccaaaagacccucuauaauacagaaaaugcuuauguuucuguagugucuucacauuauagcagaaaauucaccccagaaauagcuaaaagacccaaaguaagagaucaagaaggaagaaucaacuacuacuggacucugcuugaacccggggauacaauaauguuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38320 - RNA, 1698 nt, Artificial Sequence
  hemagglutinin__InfluenzaA__AET84449
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugagagauucgaaauauuccccaaagaaagcucauggcccaaccacaccacaaccggaguaucagcaucaugcucccauaauggggaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaagggcucucuaucauacagaaaaugcuuaugucucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggauggaugugaugcgaagugucaaacaccucagggagcuauaaacagcagucuuccuuuccagaauguacacccugucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38321 - RNA, 1701 nt, Artificial Sequence
  hemagglutinin__InfluenzaA__AET98600
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacugugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugccccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguggaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38322 - RNA, 1701 nt, Artificial Sequence
  hemagglutinin__InfluenzaA__AEV76874
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucauucuccacagcaagcucaugguccuacauuguggaaacaucuaguucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaacccggaaauagaaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaacgagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuucuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38323 - RNA, 1701 nt, Artificial Sequence; identical to SEQ ID NO: 33173
  hemagglutinin__InfluenzaA__AEW10574

SEQ ID NO: 38324 - RNA, 1701 nt, Artificial Sequence; identical to SEQ ID NO: 33173
  hemagglutinin__InfluenzaA__AEW10584

SEQ ID NO: 38325 - RNA, 1701 nt, Artificial Sequence
  hemagglutinin__InfluenzaA__AEW10594
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagaaaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38326 - RNA, 1701 nt, Artificial Sequence; identical to SEQ ID NO: 34845
  hemagglutinin__InfluenzaA__AEW10604

SEQ ID NO: 38327 - RNA, 1701 nt, Artificial Sequence; identical to SEQ ID NO: 37712
  hemagglutinin__InfluenzaA__AEW10614

SEQ ID NO: 38328 - RNA, 1701 nt, Artificial Sequence; identical to SEQ ID NO: 34264
  hemagglutinin__InfluenzaA__AEW10624

SEQ ID NO: 38329 - RNA, 1701 nt, Artificial Sequence; identical to SEQ ID NO: 33173
  hemagglutinin__InfluenzaA__AEW10634

SEQ ID NO: 38330 - RNA, 1701 nt, Artificial Sequence; identical to SEQ ID NO: 33168
  hemagglutinin__InfluenzaA__AEW10644

SEQ ID NO: 38331 - RNA, 1701 nt, Artificial Sequence
  hemagglutinin__InfluenzaA__AEW10654
augaaggcaauacuaguaguucugcuauauacauuugcaaccgcaaaugcagacacauuauguauagguuaucaugcgaacaauucaacagacacuguagacacagugcuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucuuuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38332 - RNA, 1701 nt, Artificial Sequence; identical to SEQ ID NO: 33197
  hemagglutinin__InfluenzaA__AEW10664

SEQ ID NO: 38333 - RNA, 1701 nt, Artificial Sequence
  hemagglutinin__InfluenzaA__AEW10674
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcugaagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38334 - RNA, 1701 nt, Artificial Sequence; identical to SEQ ID NO: 33173
  hemagglutinin__InfluenzaA__AEW10684

SEQ ID NO: 38335 - RNA, 1701 nt, Artificial Sequence; identical to SEQ ID NO: 33168
  hemagglutinin__InfluenzaA__AEW10694

SEQ ID NO: 38336 - RNA, 1701 nt, Artificial Sequence; identical to SEQ ID NO: 33197
  hemagglutinin__InfluenzaA__AEW10704

SEQ ID NO: 38337 - RNA, 1701 nt, Artificial Sequence; identical to SEQ ID NO: 38331
  hemagglutinin__InfluenzaA__AEW10724

SEQ ID NO: 38338 - RNA, 1701 nt, Artificial Sequence
  hemagglutinin__InfluenzaA__AEW10734
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauuccaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38339 - RNA, 1701 nt, Artificial Sequence
  hemagglutinin__InfluenzaA__AEW10744
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucuaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38340 - RNA, 1701 nt, Artificial Sequence; identical to SEQ ID NO: 38339
  hemagglutinin__InfluenzaA__AEW10754

SEQ ID NO: 38341 - RNA, 1701 nt, Artificial Sequence
  hemagglutinin__InfluenzaA__AEW10764
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcaaaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38342 - RNA, 1701 nt, Artificial Sequence; identical to SEQ ID NO: 33417
  hemagglutinin__InfluenzaA__AEW10774

SEQ ID NO: 38343 - RNA, 1701 nt, Artificial Sequence; identical to SEQ ID NO: 33168
  hemagglutinin__InfluenzaA__AEW10784

SEQ ID NO: 38344 - RNA, 1701 nt, Artificial Sequence; identical to SEQ ID NO: 33168
  hemagglutinin__InfluenzaA__AEW10794

SEQ ID NO: 38345 - RNA, 1701 nt, Artificial Sequence
  hemagglutinin__InfluenzaA__AEW10804
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggauuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38346 - RNA, 1701 nt, Artificial Sequence; identical to SEQ ID NO: 33171
  hemagglutinin__InfluenzaA__AEW10814

SEQ ID NO: 38347 - RNA, 1701 nt, Artificial Sequence; identical to SEQ ID NO: 33264
  hemagglutinin__InfluenzaA__AEW10824

SEQ ID NO: 38348 - RNA, 1701 nt, Artificial Sequence; identical to SEQ ID NO: 33168
  hemagglutinin__InfluenzaA__AEW10834

SEQ ID NO: 38349 - RNA, 1701 nt, Artificial Sequence; identical to SEQ ID NO: 33390
  hemagglutinin__InfluenzaA__AEW10844

SEQ ID NO: 38350 - RNA, 1701 nt, Artificial Sequence
  hemagglutinin__InfluenzaA__AEW10854
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauaacaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38351 - RNA, 1701 nt, Artificial Sequence; identical to SEQ ID NO: 33390
  hemagglutinin__InfluenzaA__AEW10864

SEQ ID NO: 38352 - RNA, 1701 nt, Artificial Sequence; identical to SEQ ID NO: 33390
  hemagglutinin__InfluenzaA__AEW10874

SEQ ID NO: 38353 - RNA, 1701 nt, Artificial Sequence; identical to SEQ ID NO: 33390
  hemagglutinin__InfluenzaA__AEW10884

SEQ ID NO: 38354 - RNA, 1701 nt, Artificial Sequence; identical to SEQ ID NO: 33403
  hemagglutinin__InfluenzaA__AEW10894

SEQ ID NO: 38355 - RNA, 1701 nt, Artificial Sequence; identical to SEQ ID NO: 33390
  hemagglutinin__InfluenzaA__AEW10904

SEQ ID NO: 38356 - RNA, 1701 nt, Artificial Sequence; identical to SEQ ID NO: 33390
  hemagglutinin__InfluenzaA__AEW10914

SEQ ID NO: 38357 - RNA, 1701 nt, Artificial Sequence; identical to SEQ ID NO: 33197
  hemagglutinin__InfluenzaA__AEW10924

SEQ ID NO: 38358 - RNA, 1701 nt, Artificial Sequence; identical to SEQ ID NO: 33403
  hemagglutinin__InfluenzaA__AEW10934

SEQ ID NO: 38359 - RNA, 1701 nt, Artificial Sequence; identical to SEQ ID NO: 33390
  hemagglutinin__InfluenzaA__AEW10944

SEQ ID NO: 38360 - RNA, 1701 nt, Artificial Sequence; identical to SEQ ID NO: 33173
  hemagglutinin__InfluenzaA__AEW10954

SEQ ID NO: 38361 - RNA, 1701 nt, Artificial Sequence; identical to SEQ ID NO: 33173
  hemagglutinin__InfluenzaA__AEW10964

SEQ ID NO: 38362 - RNA, 1701 nt, Artificial Sequence; identical to SEQ ID NO: 33390
  hemagglutinin__InfluenzaA__AEW10974

SEQ ID NO: 38363 - RNA, 1701 nt, Artificial Sequence; identical to SEQ ID NO: 33173
  hemagglutinin__InfluenzaA__AEW10984

SEQ ID NO: 38364 - RNA, 1701 nt, Artificial Sequence; identical to SEQ ID NO: 33173
  hemagglutinin__InfluenzaA__AEW10994

SEQ ID NO: 38365 - RNA, 1701 nt, Artificial Sequence; identical to SEQ ID NO: 33173
  hemagglutinin__InfluenzaA__AEW11004

SEQ ID NO: 38366 - RNA, 1701 nt, Artificial Sequence
  hemagglutinin__InfluenzaA__AEW11014
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauauucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38367 - RNA, 1701 nt, Artificial Sequence; identical to SEQ ID NO: 33173
  hemagglutinin__InfluenzaA__AEW11024

SEQ ID NO: 38368 - RNA, 1701 nt, Artificial Sequence; identical to SEQ ID NO: 33173
  hemagglutinin__InfluenzaA__AEW11034

SEQ ID NO: 38369 - RNA, 1701 nt, Artificial Sequence
  hemagglutinin__InfluenzaA__AEW11044
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaaucauacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38370 - RNA, 1701 nt, Artificial Sequence; identical to SEQ ID NO: 33173
  hemagglutinin__InfluenzaA__AEW11054

SEQ ID NO: 38371 - RNA, 1701 nt, Artificial Sequence; identical to SEQ ID NO: 33168
  hemagglutinin__InfluenzaA__AEW11064

SEQ ID NO: 38372 - RNA, 1701 nt, Artificial Sequence; identical to SEQ ID NO: 33168
  hemagglutinin__InfluenzaA__AEW11074

SEQ ID NO: 38373 - RNA, 1701 nt, Artificial Sequence
  hemagglutinin__InfluenzaA__AEW11084
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugucuucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38374 - RNA, 1701 nt, Artificial Sequence; identical to SEQ ID NO: 33168
  hemagglutinin__InfluenzaA__AEW11094

SEQ ID NO: 38375 - RNA, 1701 nt, Artificial Sequence; identical to SEQ ID NO: 33168
  hemagglutinin__InfluenzaA__AEW11104

SEQ ID NO: 38376 - RNA, 1701 nt, Artificial Sequence; identical to SEQ ID NO: 33173
  hemagglutinin__InfluenzaA__AEW11114

SEQ ID NO: 38377 - RNA, 1701 nt, Artificial Sequence
  hemagglutinin__InfluenzaA__AEW11124
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauuuguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38378 - RNA, 1701 nt, Artificial Sequence
  hemagglutinin__InfluenzaA__AEW11134
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacaaagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38379 - RNA, 1701 nt, Artificial Sequence; identical to SEQ ID NO: 33472
  hemagglutinin__InfluenzaA__AEW11144

SEQ ID NO: 38380 - RNA, 1701 nt, Artificial Sequence; identical to SEQ ID NO: 33472
  hemagglutinin__InfluenzaA__AEW11154

SEQ ID NO: 38381 - RNA, 1701 nt, Artificial Sequence
  hemagglutinin__InfluenzaA__AEW11164
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugucuucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38382 - RNA, 1701 nt, Artificial Sequence; identical to SEQ ID NO: 38373
  hemagglutinin__InfluenzaA__AEW11174

SEQ ID NO: 38383 - RNA, 1701 nt, Artificial Sequence; identical to SEQ ID NO: 33173
  hemagglutinin__InfluenzaA__AEW11184

SEQ ID NO: 38384 - RNA, 1701 nt, Artificial Sequence; identical to SEQ ID NO: 33168
  hemagglutinin__InfluenzaA__AEW11194

SEQ ID NO: 38385 - RNA, 1701 nt, Artificial Sequence; identical to SEQ ID NO: 33173
  hemagglutinin__InfluenzaA__AEW11204

SEQ ID NO: 38386 - RNA, 1701 nt, Artificial Sequence; identical to SEQ ID NO: 38178
  hemagglutinin__InfluenzaA__AEW11214

SEQ ID NO: 38387 - RNA, 1701 nt, Artificial Sequence
  hemagglutinin__InfluenzaA__AEW11224
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagagauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38388 - RNA, 1701 nt, Artificial Sequence; identical to SEQ ID NO: 33173
  hemagglutinin__InfluenzaA__AEW11234

SEQ ID NO: 38389 - RNA, 1701 nt, Artificial Sequence; identical to SEQ ID NO: 33173
  hemagglutinin__InfluenzaA__AEW11244

SEQ ID NO: 38390 - RNA, 1701 nt, Artificial Sequence
  hemagglutinin__InfluenzaA__AEW11254
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugucuucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucugcuagugcugaccaacaaagucucuaucagaaugcagaugcauauguuuuuguggggucaucaagauacagcaagaaggucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38391 - RNA, 1701 nt, Artificial Sequence; identical to SEQ ID NO: 33168
  hemagglutinin__InfluenzaA__AEW11263

SEQ ID NO: 38392 - RNA, 1701 nt, Artificial Sequence; identical to SEQ ID NO: 33168
  hemagglutinin__InfluenzaA__AEW11273

SEQ ID NO: 38393 - RNA, 1701 nt, Artificial Sequence; identical to SEQ ID NO: 33168
  hemagglutinin__InfluenzaA__AEW11283

SEQ ID NO: 38394 - RNA, 1701 nt, Artificial Sequence; identical to SEQ ID NO: 33168
  hemagglutinin__InfluenzaA__AEW11293

SEQ ID NO: 38395 - RNA, 1701 nt, Artificial Sequence
  hemagglutinin__InfluenzaA__AEW11303
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaguauguauuuaa

SEQ ID NO: 38396 - RNA, 1701 nt, Artificial Sequence; identical to SEQ ID NO: 33168
  hemagglutinin__InfluenzaA__AEW11313

SEQ ID NO: 38397 - RNA, 1701 nt, Artificial Sequence
  hemagglutinin__InfluenzaA__AEW11323
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuaggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuguaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38398 - RNA, 1701 nt, Artificial Sequence
  hemagglutinin__InfluenzaA__AEW22712
augaaggcaauacuaguaguucugcuauauacauuugcaaccgcaaaugcagacacauuauguauagguuaccaugcgaacaauucaacagacacuauagacacaguacuagaaaagaauguaacaguaacacacucuguuaaucuucuagaagacaagcauaacgggaaacuaugcaagcuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguaaagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaacgagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuucuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 38399 - RNA, 1701 nt, Artificial Sequence
  hemagglutinin__InfluenzaA__AEW22718
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguaaagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaacgagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuucuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 38400 - RNA, 1701 nt, Artificial Sequence
  hemagglutinin__InfluenzaA__AEW22720
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaacgagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuucuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 38401 - RNA, 1701 nt, Artificial Sequence; identical to SEQ ID NO: 38400
  hemagglutinin__InfluenzaA__AEW22722

SEQ ID NO: 38402 - RNA, 1701 nt, Artificial Sequence
  hemagglutinin__InfluenzaA__AEW22724
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguggccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaacgagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuucuggacauuuggacuuacaaugccgaacuguugguucuauuggaaaaugaaagaacuuuggacuaccacgauucaaaugugaagaacuuauaugaaaagguaagaaaccaguuaaaaaacaaugccagggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 38403 - RNA, 1701 nt, Artificial Sequence
  hemagglutinin__InfluenzaA__AEW25297
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggaucccgggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaggggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38404 - RNA, 1701 nt, Artificial Sequence
  hemagglutinin__InfluenzaA__AEW25306
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacgcccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38405 - RNA, 1701 nt, Artificial Sequence
  hemagglutinin__InfluenzaA__AEW25315
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaguccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucugggugugcucuaaugggucucuacaguguagaauauguauuuaa

SEQ ID NO: 38406 - RNA, 1701 nt, Artificial Sequence
  hemagglutinin__InfluenzaA__AEW25331
augaaggcaauacuaguaguucugcuauauacauuugcaaccgcaaaugcagacacauuauguauagguuaucaugcgaacaauucaacagacacuguagauacaguacuagaaaagaauguaacaguaacacacuccguuaaccuucuagaagacaagcauaacgggaaacuaugcaaacuaagagggguagccccauugcauuuggguaaauguaacauugcuggcuggauccugggaaauccagagugugaaucauucuccacaucaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauaccuccgaucacaauuggaaaauguccaaaauauguaaaaagcacaaaauuaagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38407 - RNA, 1701 nt, Artificial Sequence
  hemagglutinin__InfluenzaA__AEW25349
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucauucuccacaucaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaagaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38408 - RNA, 1701 nt, Artificial Sequence
  hemagglutinin__InfluenzaA__AEW25367
augaaggcaauacuaguaguucugcuauauacauuugcaaccgcaaaugcagacacauuauguauagguuaucaugcgaacaauucaacagacacuguagauacaguacuagaaaagaauguaacaguaacacacuccguuaaccuucuagaagacaagcauaacgggaaacuaugcaaacuaagagggguagccccauugcauuuggguaaauguaacauugcuggcuggauccugggaaauccagagugugaaucauucuccacaucaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaacgucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauuaagacuggccacaggauugaggaaugucccgucuauucaaucuagaggccuauuuggggccauugccgguuucauugaagggggguggacagggaugguagauggaugguacgguuaucaccaucaaaaugagcaggggucaggauauacagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38409 - RNA, 1701 nt, Artificial Sequence
  hemagglutinin__InfluenzaA__AEW25377
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggugugacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaaaagccaguuaaagaacaaugccaaggaaauuggaaacggcugcuuugaauuuuaccacaaaugcgauaacgcgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38410 - RNA, 1701 nt, Artificial Sequence
  hemagglutinin__InfluenzaA__AEW25385
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugccaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacugggaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38411 - RNA, 1701 nt, Artificial Sequence
  hemagglutinin__InfluenzaA__AEW25416
augaaggcaauacuaguaguucugcuauauacauuugcaaccgcaaaugcagacacauuauguauagguuaucaugcgaacaauucaacagacacuguagacacaguacuagaaaagaauguaacuguaacacacuccguuaaccuucuagaagacaagcauaacgggaaacuaugcaaacuaagagggguagccccauugcauuuggguaaauguaacauugcuggcuggauccugggaaauccagagugugaaucauucuccacaucaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauuaagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38412 - RNA, 1701 nt, Artificial Sequence
  hemagglutinin__InfluenzaA__AEW25446
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauaaacaguucacagcaguaggcaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38413 - RNA, 1701 nt, Artificial Sequence
  hemagglutinin__InfluenzaA__AEW25454
augaaggcaauacuaguaguucugcuauauacauuugcaaccgcaaaugcagacacauuauguauagguuaucaugcgaacaauucaacagacacuguagacacaguacuagaaaagaauguaacaguaacacacuccguuaaccuucuagaagacaagcauaacgggaaacuaugcaaacuaagagggguagccccauugcauuuggguaaauguaacauugcuggcuggauccugggaaauccagagugugaaucauucuccacaucaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagacggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38414 - RNA, 1701 nt, Artificial Sequence
  hemagglutinin__InfluenzaA__AEW25462
augaaggcaauacuaguaguucugcuauauacuuuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaacccuacacuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38415 - RNA, 1701 nt, Artificial Sequence
  hemagglutinin__InfluenzaA__AEW25472
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuauuauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaucaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38416 - RNA, 1701 nt, Artificial Sequence
  hemagglutinin__InfluenzaA__AEW25482
augaaggcaauacuaguaguucugcuauauacauuugcaaccgcaaaugcagacacauuauguauagguuaucaugcgaacaauucaacagacacuguagacacaguacuagaaaagaaaguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaguccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaaggagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuguaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38417 - RNA, 1701 nt, Artificial Sequence
  hemagglutinin__InfluenzaA__AEW25492
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauauuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacaugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38418 - RNA, 1701 nt, Artificial Sequence
  hemagglutinin__InfluenzaA__AEW25501
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaaaguuugagauauuccccaagacaaguucauggcccaaucaugacucgaacaaagguguaacggcagcauguccucaugcuggagcaaaaagcuucuacaaaaauuuaauaugccuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38419 - RNA, 1701 nt, Artificial Sequence
  hemagglutinin__InfluenzaA__AEW25509
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucauucuccacaucaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauuaagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38420 - RNA, 1701 nt, Artificial Sequence
  hemagglutinin__InfluenzaA__AEW25519
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucauacuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38421 - RNA, 1701 nt, Artificial Sequence
  hemagglutinin__InfluenzaA__AEW25528
augaaggcaauacuaguaguucugcuauauacauuugcaaccgcaaaugcagacacauuauguauagguuaucaugcgaacaauucaacagacacuguagacacaguacuagaaaagaauguaacaguaacacacuccguuaaccuucuagaagacaagcauaacgggaaacuaugcaaacuaagagggguagccccauugcauuuggguaaauguaacauugcuggcuggauccugggaaauccagagugugaaucauucuccacaucaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaaaggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauuaagacuggccacaggauugaggaaugucccgucuauucaaucuagaggccuauuuggggccauugccgguuucauugaagggggguggacagggaugguagacggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38422 - RNA, 1701 nt, Artificial Sequence
  hemagglutinin__InfluenzaA__AEW25545
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcugguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggaguuaugacuacccaaaauacucagaggaagcaaaauuaaacagagaagaaauagaugggguaaagcuggaaucaacaaggauuuaccagauuuuggcgaucuauucaacugucgccaguucauugguaaugguaguuucccugggggcaaucaguuucuggaugugcucuaauggaucucuacaguguagaauauguauuuaa

SEQ ID NO: 38423 - RNA, 1701 nt, Artificial Sequence
  hemagglutinin__InfluenzaA__AEW25555
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuggaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacuauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcgaucaguuucuggaugugcucuaaugggucucuacaguguagaauauguauuuaa

SEQ ID NO: 38424 - RNA, 1701 nt, Artificial Sequence
  hemagglutinin__InfluenzaA__AEW25564
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuuuaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauagaaaaguugaugaugguuuccuggacauuuggacuuacaaugccgaacuguugguucuauuggaaaaugaaagaacuuuggacuaccacgauucaaaugugaagaacuuauaugaaaaggugagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacagggauuuaccagauuuuggcgaucuauucaacugucgccaguucauugguacugguagucucccugggggcaaucaguuucuggauguguucuaaugggucucuacaguguagaauauguauuuaa

SEQ ID NO: 38425 - RNA, 1701 nt, Artificial Sequence
  hemagglutinin__InfluenzaA__AEW25573
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38426 - RNA, 1701 nt, Artificial Sequence
  hemagglutinin__InfluenzaA__AEW25582
augaaggcaauacuaguaguucugcuauauacauuugcaaccgcaaaugcagacacauuauguauagguuaucaugcgaacaauucaacggacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagagaucaagaagggagaaugaacuauuacuggacacuaguagagccgggagacaaaauaacauucgaagcaacuggaaaucuagugguaccgagauaugcauucgcaauggaaagaaaugcuggaucugguauuauccuuucagauacaccaguccacgauugcaauacaacuugucagacacccaagggugcuauaaacacuagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugggcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38427 - RNA, 1701 nt, Artificial Sequence
  hemagglutinin__InfluenzaA__AEW25590
augaaggcaauacuaguaguucugcuauauacauuugcaaccgcaaaugcagacacauuauguauagguuaucaugcgaacaauucaacagacacuguagacacaguacuagagaagaauguaacaguaacacaaucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagcgcugaccaacaaagucucuaucagaaugcagaugcauauguuuuuguggggacaucaagauacagcaagaaguucaagccggaaauagcaauaagacccaaagugagggaucaagaagcgagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugaacagggaucaggauaugcagccgaccugaagagcacacagaaugccauugacgagauuacuaacaaaguaaauucuguuauugaaaagaugaauacacaguucacggcaguagguaaagaguucaaccaccuggaaaaaagaauagagaauuuaaauaaaaaaguugaugaugguuuccuggauauuuggacuuacaaugccgaacuguugguucuauuggaaaaugaaagaacuuuggacuaccacgauucaaaugugaagaacuuacaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguaucuaa

SEQ ID NO: 38428 - RNA, 1701 nt, Artificial Sequence; identical to SEQ ID NO: 38425
  hemagglutinin__InfluenzaA__AEW25600

SEQ ID NO: 38429 - RNA, 1701 nt, Artificial Sequence; identical to SEQ ID NO: 33971
  hemagglutinin__InfluenzaA__AEW25620

SEQ ID NO: 38430 - RNA, 1701 nt, Artificial Sequence
  hemagglutinin__InfluenzaA__AEW25629
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcugaagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaucaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacaugugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38431 - RNA, 1701 nt, Artificial Sequence
  hemagglutinin__InfluenzaA__AEW25637
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucuggcauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38432 - RNA, 1701 nt, Artificial Sequence
  hemagglutinin__InfluenzaA__AEW25646
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaauggaucucuacaguguagaauauguauuuaa

SEQ ID NO: 38433 - RNA, 1701 nt, Artificial Sequence
  hemagglutinin__InfluenzaA__AEW25654
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccccccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38434 - RNA, 1701 nt, Artificial Sequence
  hemagglutinin__InfluenzaA__AEW25662
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguauaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38435 - RNA, 1701 nt, Artificial Sequence
  hemagglutinin__InfluenzaA__AEW25669
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagagggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaauggaucucuacaguguagaauauguauuuaa

SEQ ID NO: 38436 - RNA, 1701 nt, Artificial Sequence
  hemagglutinin__InfluenzaA__AEW25678
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaaaguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauuaagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaaggacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugagggcaaucaguuucuggaugugcucuaaugggucucuacaguguagaauauguauuuaa

SEQ ID NO: 38437 - RNA, 1701 nt, Artificial Sequence
  hemagglutinin__InfluenzaA__AEW25687
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccuuaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaauggaucucuacaguguagaauauguauuuaa

SEQ ID NO: 38438 - RNA, 1701 nt, Artificial Sequence
  hemagglutinin__InfluenzaA__AEW25696
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucauucuccacaucaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauaugugaaaagcacaaaauuaagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38439 - RNA, 1701 nt, Artificial Sequence
  hemagglutinin__InfluenzaA__AEW25706
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauacgaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38440 - RNA, 1695 nt, Artificial Sequence
  hemagglutinin__InfluenzaA__AEW91908
auggagaaaauagugcuucuuuuugcaacaaucagccuuguuaaaagcgaucauauuugcauugguuaucaugcaaauaacucgacagagcagguugacacaauaauggaaaagaacgugacuguuacacaugcccaagacauacuggaaaagacacacaacgguaagcucugcgaucuaaauggagugaagccucugauuuuaaaagauuguaguguagcaggauggcuccucggaaauccaaugugugacgaauucaucaaugugccagaauggucuuacauaguagagaaggccaauccagccaaugaccucuguuacccagggaauuucaacgauuaugaagaauugaaacaccuauugagcaggauaaaccauuuugagaaaauacagaucauccccaaaaauucuuggucagaucaugaagccucguugggggugagugcagcauguccauaccagggaaaauccuccuucuucagaaaugugguauggcuuaucaaaaaggacaaugcauacccaacaauaaagaaaggcuacaauaauaccaaccaagaagaucucuugguacugugggggauucaccauccuaaugaugaggcagagcagacaaggcucuaucaaaacccaaccaccuauauuuccauugggacaucaacacuaaaccagagauugguaccaaaaauagccacuagguccaaaauaaacgggcaaaguggcaggauagauuucuucuggacaauuuuaaaaccgaaugaugcaauccacuucgagaguaauggaaauuucauugcuccagaauaugcauacaaaauugucaagaaaggagacucaacaauuaugaaaagugaaguggaauaugguaacugcaacaccaggugucagacuccaauaggggcgauaaacuccaguaugccauuccacaacauacacccucucaccaucggagaaugucccaaauaugugaaaucaaacaaacuaguccuugcgacugggcucagaaauagcccucaaggagagacgcgaggacuguuuggagcuauagcagguuuuauagagggaggauggcagggaaugguagaugguugguauggguaccaccacagcaaugagcaggggaguggguacgcugcagacaaagaaucuacucaaaaggcaauagacggggucaccaauaaggucaacucgaucauugacaaaaugaacacucaguuugaggccguaggaagggaauuuaauaacuuagagaggagaauagagaauuugaacaagaagauggaagauggauuccuagaugucuggacuuauaaugcugaacuucugguucucauggaaaaugagagaacucuagacuuccaugacucaaaugucaggaaccuuuacgacaaggucagacuacagcuuaaggauaaugcaaaagagcuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaaucuaccaaauacugucaauuuauucaacaguggcgaguucccuaguacuggcaaucaugauggcuggucuaucuuuauggauguguuccaacgggucguuacagugcagaauuugcauuuaa

SEQ ID NO: 38441 - RNA, 1701 nt, Artificial Sequence
  hemagglutinin__InfluenzaA__AEX09175
augaaggcaauacuaguaguucugcuauauacauuugcaaccgcaaaugcagacacauuauguauagguuaucaugcgaacaauucaacagacacuguagacacaguacuagaaaagaauguagcaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuagaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38442 - RNA, 1701 nt, Artificial Sequence; identical to SEQ ID NO: 36713
  hemagglutinin__InfluenzaA__AEX25795

SEQ ID NO: 38443 - RNA, 1701 nt, Artificial Sequence
  hemagglutinin__InfluenzaA__AEX25797
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaaugguacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38444 - RNA, 1701 nt, Artificial Sequence
  hemagglutinin__InfluenzaA__AEX25798
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaaugguacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38445 - RNA, 1701 nt, Artificial Sequence; identical to SEQ ID NO: 33173
  hemagglutinin__InfluenzaA__AEX25800

SEQ ID NO: 38446 - RNA, 1701 nt, Artificial Sequence; identical to SEQ ID NO: 33173
  hemagglutinin__InfluenzaA__AEX25803

SEQ ID NO: 38447 - RNA, 1701 nt, Artificial Sequence; identical to SEQ ID NO: 33457
  hemagglutinin__InfluenzaA__AEX25808

SEQ ID NO: 38448 - RNA, 1701 nt, Artificial Sequence
  hemagglutinin__InfluenzaA__AEX25810
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccaucaaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgacuugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38449 - RNA, 1701 nt, Artificial Sequence
  hemagglutinin__InfluenzaA__AEX25811
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuucacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaggcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38450 - RNA, 1701 nt, Artificial Sequence; identical to SEQ ID NO: 36143
  hemagglutinin__InfluenzaA__AEX25814

SEQ ID NO: 38451 - RNA, 1701 nt, Artificial Sequence
  hemagglutinin__InfluenzaA__AEX25816
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaacucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38452 - RNA, 1701 nt, Artificial Sequence
  hemagglutinin__InfluenzaA__AEX25818
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccaucaaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38453 - RNA, 1701 nt, Artificial Sequence
  hemagglutinin__InfluenzaA__AEX25824
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauaugguuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucagguauuaucauuucagacacaccaguccacgauugcaauacaacuugucagacacccaagggugcuauaaacaccagccucccauuucagaauauacauccgaucacaauuggaaaauguccaaaauauguagaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38454 - RNA, 1698 nt, Artificial Sequence
  hemagglutinin__InfluenzaA__AEX33420
augaaaguaaaacuacugguccuguuauguauauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccagguuauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacagaaauuugcuauggcugacggggaagagugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaagagugcaaaauuaaggaugguuacaggacuaaggaacaucccauccauucaauccagggguuuguuuggagccauugccgguuucauugaagggggguggacuggaaugguagaugguugguaugguuaucaucaucagaaugagcaaggaucuggcuaugcugcagaucagaaaaguacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaguucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 38455 - RNA, 1701 nt, Artificial Sequence
  hemagglutinin__InfluenzaA__AEX33453
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucugauaaaaguuucuuuaguagauugaauugguugacccaucuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaggacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38456 - RNA, 1701 nt, Artificial Sequence
  hemagglutinin__InfluenzaA__AEX33464
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaacguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38457 - RNA, 1701 nt, Artificial Sequence; identical to SEQ ID NO: 38456
  hemagglutinin__InfluenzaA__AEX33475

SEQ ID NO: 38458 - RNA, 1701 nt, Artificial Sequence; identical to SEQ ID NO: 38456
  hemagglutinin__InfluenzaA__AEX33486

SEQ ID NO: 38459 - RNA, 1701 nt, Artificial Sequence; identical to SEQ ID NO: 38456
  hemagglutinin__InfluenzaA__AEX33497

SEQ ID NO: 38460 - RNA, 1701 nt, Artificial Sequence; identical to SEQ ID NO: 38456
  hemagglutinin__InfluenzaA__AEX33508

SEQ ID NO: 38461 - RNA, 1701 nt, Artificial Sequence; identical to SEQ ID NO: 38456
  hemagglutinin__InfluenzaA__AEX33519

SEQ ID NO: 38462 - RNA, 1701 nt, Artificial Sequence
  hemagglutinin__InfluenzaA__AEX33541
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccagaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucuucuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaagagcacucaagcagcaaucaaccaaaucaaugggaaacugaauagguuaaucgggaaaacaaacgagaaauuccaucagauugaaaaagaauucucggaaguagaaggaagaauucaggaccuugagaaauauguugaggacacuaaaauagaucucuggucauacaacgcggagcuucuuguugcccuggagaaccaacauacaauugaucuaacagacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38463 - RNA, 1701 nt, Artificial Sequence
  hemagglutinin__InfluenzaA__AEX33574
augaagacuaucauugcuuuaagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugacugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38464 - RNA, 1701 nt, Artificial Sequence; identical to SEQ ID NO: 38456
  hemagglutinin__InfluenzaA__AEX33585

SEQ ID NO: 38465 - RNA, 1701 nt, Artificial Sequence
  hemagglutinin__InfluenzaA__AEX33596
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaacguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38466 - RNA, 1701 nt, Artificial Sequence; identical to SEQ ID NO: 38456
  hemagglutinin__InfluenzaA__AEX33618

SEQ ID NO: 38467 - RNA, 1701 nt, Artificial Sequence; identical to SEQ ID NO: 38456
  hemagglutinin__InfluenzaA__AEX33629

SEQ ID NO: 38468 - RNA, 1701 nt, Artificial Sequence; identical to SEQ ID NO: 38465
  hemagglutinin__InfluenzaA__AEX33640

SEQ ID NO: 38469 - RNA, 1701 nt, Artificial Sequence
  hemagglutinin__InfluenzaA__AEX33836
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcuggugcagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacccaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauauuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38470 - RNA, 1701 nt, Artificial Sequence
  hemagglutinin__InfluenzaA__AEX33880
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguagaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38471 - RNA, 1698 nt, Artificial Sequence
  hemagglutinin__InfluenzaA__AEX33913
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugagagauucgaaauauuccccaaagaaaacucauggcccaaccacaccacaaccggaguaucagcaucaugcucccauaauggggaaagcaguuuuuacaaaaauuugcuauggcugacggggaagaaugguuuguacccaaaccugagcaaguccuaugcaaacaacaaaaagaaagaaguccuuguacuaugggguguucaucacccgccuaacauagguaaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuugaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38472 - RNA, 1698 nt, Artificial Sequence
  hemagglutinin__InfluenzaA__AEX33924
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaaucacugauuuccagggaaucaugguccuacauuguagaaaaaccaaguccugagaaugggacauguuacccagggcauuucgccgacuaugaggaacuaagggagcaauugaguucaguaucuucauuugagagauucgaaauauuccccaaagaaagcucauggcccaaccacaccgcaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgcccaacauaggugaccaaagggcccucuaucauacagaaaaugcuuaugucucuguagugucuucacauuauagcagaaaauucaccccagaaauagccaaaagacccaaaguaagagaucaaaaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagagucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38473 - RNA, 1701 nt, Artificial Sequence
  hemagglutinin__InfluenzaA__AEX33957
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaguugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugauaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38474 - RNA, 1701 nt, Artificial Sequence
  hemagglutinin__InfluenzaA__AEX33968
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccugcaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38475 - RNA, 1701 nt, Artificial Sequence
  hemagglutinin__InfluenzaA__AEX33979
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcauuuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugaaggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaauggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38476 - RNA, 1701 nt, Artificial Sequence
  hemagglutinin__InfluenzaA__AEX33990
augaagacuaucauugcuuugagcuacauucuauaucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaagacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaauggcuguuucaaaauauaccacaaaugugacaaugccugcauaggaucaaucagaaauggaacuuaugaccacgauguauacagagaugaagcauuaaacaaccgguuccagaucaagagcguugagcugaagucaggauacaaagauuggauccuauggauuuccuuugccauaucauguuuuuugcuuuguguugcuuuguugggguucaucaugugggccugccaaaaaggcaacauuagguguaacauuugcauuuga

SEQ ID NO: 38477 - RNA, 1701 nt, Artificial Sequence
  hemagglutinin__InfluenzaA__AEX34001
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauuaggagacccucagugugauggcuuccaaaauaagaaaugggaccuuuuuguugaacgcagcaaggccuacagcaacuguuacccuuaugaugugccggauuaugcuucccuuaggucacuaguugccucauccggcacacuggaguuuaacagugaaagcuucaauuggacuggagucacucaaaauggaacaagcucugcuugcaaaaggagaucuaauaacaguuucuuuaguagauugaauugguugacucacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaauuccgaauaucggaucuagacccagaguaaggaacauccccagcagaauaagcaucuauuggacaauaguaaaaccuggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaaugcugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggagaaugcugaggauaugggcaaugguuguuucaaaauauaccacaaaugugacaaugccugcauaggaucaaucagaaauggaacuuaugaccaugauguauacagagaugaagcauuaaacaaccguuuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38478 - RNA, 1701 nt, Artificial Sequence
  hemagglutinin__InfluenzaA__AEX34012
augaagacuaucauugcuuugagcuacauucuauaucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccagguacggacaaugaccaaaucuuccuguaugcucaagcaucaggaagaaucacagucucuaccaaaagaagccaacaaacuguaaucccgaauaucggaucuagacccagaguaagaaauauccccagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcucuggagaaccaacauacaauugaucuaacugauucagaaaugaacaaacuguuugaaaaaacaaagaagcaacugagggaaaaugcugaggauaugggcaauggcuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuagguguaacauuugcauuuga

SEQ ID NO: 38479 - RNA, 1701 nt, Artificial Sequence
  hemagglutinin__InfluenzaA__AEX34023
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcuuuauugggagacccucaaugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacagacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38480 - RNA, 1701 nt, Artificial Sequence
  hemagglutinin__InfluenzaA__AEX34044
augaagacuaucauugcuuuuagcuacauucuaugucugguuuucgcucaaaaacuucccggaauugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugccccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38481 - RNA, 1701 nt, Artificial Sequence
  hemagglutinin__InfluenzaA__AEX34089
augaagacuaucauugcuuugagcuacauucuaugucugguuuucgcucaaaaacuucccggaauugacaacagcacggcaacgcugugucuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaguaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccuaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38482 - RNA, 1701 nt, Artificial Sequence
  hemagglutinin__InfluenzaA__AEX34123
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggacuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38483 - RNA, 1701 nt, Artificial Sequence
  hemagglutinin__InfluenzaA__AEX34134
augaagacuaucauugcuuugagcuacauucuaugucugguuuucgcucaaaaacuuccuggaaaugacaacagcauggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38484 - RNA, 1701 nt, Artificial Sequence
  hemagglutinin__InfluenzaA__AEX34145
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38485 - RNA, 1701 nt, Artificial Sequence
  hemagglutinin__InfluenzaA__AEX34156
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugccacugagcugguucagaguuccucaacaggugaaauaugcggcaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccucgagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 38486 - RNA, 1701 nt, Artificial Sequence
  hemagglutinin__InfluenzaA__AEX34178
augaagacuaucauugcuuugagcuacauucuaugucugguuuucgcucaaaaacuucccggaaaugacaacagcacagcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuucaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaucacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcauuuauuggacaauaguaaaaccgggagacauacuuuugauuaacagcacagggaaucuaauugcuccuagggguuauuucaaaauacgaagugggaaaagcucaauaaugagaucagaugcacccauuggcaaaugcaauucugaaugcauaacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcagguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38487 - RNA, 1701 nt, Artificial Sequence
  hemagglutinin__InfluenzaA__AEX34188
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguauugcuuuguugggguucaucaugugggccugccaaaaaggcaacauuaggugcaacauuugcauuuga

SEQ ID NO: 38488 - RNA, 1701 nt, Artificial Sequence
  hemagglutinin__InfluenzaA__AEX34199
augaagacuaucauugcuuugagcuacauucuaugucugguuuucgcucaaaaacuuccuggaaaugacaacagcacggcaacgcugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaauuuaacaaugaaagcuucaauuggacuggagucacucaaaauggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38489 - RNA, 1701 nt, Artificial Sequence
  hemagglutinin__InfluenzaA__AEX34221
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcgauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38490 - RNA, 1701 nt, Artificial Sequence
  hemagglutinin__InfluenzaA__AEX34243
augaagacuaucauugcuuugagcuacauucuaugucugguuuucgcucaaaaacuuccuggaaaugacaacagcacggcaacgcugugccucgggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaaaaagcaacugagggaaaaugcugaagauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38491 - RNA, 1701 nt, Artificial Sequence
  hemagglutinin__InfluenzaA__AEX34254
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaauggaaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguauugcuuuguugggguucaucaugugggccugccaaaaaggcaacauuaggugcaacauuugcauuuga

SEQ ID NO: 38492 - RNA, 1701 nt, Artificial Sequence
  hemagglutinin__InfluenzaA__AEX34265
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgauaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaacguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccaaaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38493 - RNA, 1701 nt, Artificial Sequence
  hemagglutinin__InfluenzaA__AEX34275
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucuccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaagauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccauuauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38494 - RNA, 1698 nt, Artificial Sequence
  hemagglutinin__InfluenzaA__AEX34318
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuauacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagcaaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagagugcccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuagucucccugggggcaaucagcuucuggauguguuccaaugggucuuugcaguguagaauaugcaucuaa

SEQ ID NO: 38495 - RNA, 1698 nt, Artificial Sequence
  hemagglutinin__InfluenzaA__AEX34329
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugguuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugaaggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38496 - RNA, 1701 nt, Artificial Sequence
  hemagglutinin__InfluenzaA__AEX34352
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcauuuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcauaacuccaaauggaagcauucucaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcagguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38497 - RNA, 1701 nt, Artificial Sequence
  hemagglutinin__InfluenzaA__AEX34364
augaagacuaucauugcuuugagcuacauucuaugucuggucuuugcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaucgguuccagaucaagggaguugagcuaaagucaggguacaaagauuggauccuauggauuuccuuugccauaucauguuucuugcuuuguguugcuuuguugggguucaucaugugggccugccaaaaaggcaacauuaggugcaacauuugcauuuga

SEQ ID NO: 38498 - RNA, 1701 nt, Artificial Sequence; identical to SEQ ID NO: 38497
  hemagglutinin__InfluenzaA__AEX34375

SEQ ID NO: 38499 - RNA, 1701 nt, Artificial Sequence
  hemagglutinin__InfluenzaA__AEX34386
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagagaacugcacacuaauagaugcucuauugggagacccucaaugugauggcuuccaaaauaagaaaugggaccuuuuuauugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacaguacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguuaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucaaauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38500 - RNA, 1701 nt, Artificial Sequence
  hemagglutinin__InfluenzaA__AEX34407
augaagacuaucauugcuuugagcuacauucuaugucugguuuucgcucaaaaacuuccuggaaaugacaacagcauggcaacgcugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagagaacugcacacuaauagaugcucuauugggagacccucaaugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaauucugaaugcaucacuccaaauggaagcauucccaaugacaaaccauuccaaaauguuaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaguagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38501 - RNA, 1698 nt, Artificial Sequence
  hemagglutinin__InfluenzaA__AEX34440
augaaaguaaaacuacugguucuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugacuuccagggaaucaugguccuacauuguagaaaaaccaaauccugagaauggaacauguuacccagggcauuucgccgacuaugaggaacugagggagcaauugaguucaguaucuucauuugagagauucgaaauauuccccaaagaaagcucauggcccaaccacaccacaaccggaguaucagcaucaugcucccauaauggggaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauagguaaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaaggaggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38502 - RNA, 1698 nt, Artificial Sequence
  hemagglutinin__InfluenzaA__AEX34462
augaaaguaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgcugauuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuacccaaaauauuccgaagaaucaaaguuaaacagggagaaaauugauggagugaaauuggaaucaaugggagucuaucagauucuggcgaucuacucaacggucgccaguucccugguucuuuuggucucccugggggcaaucagcuucuggauguguuccaaugggucuuugcaguguagaauaugcaucuaa

SEQ ID NO: 38503 - RNA, 1698 nt, Artificial Sequence
  hemagglutinin__InfluenzaA__AEX34473
augaaaguaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagcuccacuacaauuggguaauugcaguguugccggauggaucuuaggaaacccagaaugcgaauuacugauuuccaaggaaucaugguccuacauuguagaaacaccaaauccugagaauggaacauguuacccagguuauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacagaaauuugcuauggcugacggggaagagugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaagagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaaguacacaaagugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaguucuaucacaaguguaacgaugaaugcauggagagugugaaaaauggaacuuaugacuauccaaaauauuccgaagaaucaaaguuaaacagagagaaaauugauggagugaaauuggaaucaaugggagucuaucagauucuggcgaucuacucaacagucgccaguucccugguucuuuuggucucccugggggcaaucagcuucuggauguguuccaaugggucuuugcaauguagaauaugcaucuaa

SEQ ID NO: 38504 - RNA, 1698 nt, Artificial Sequence
  hemagglutinin__InfluenzaA__AEX34495
augaaaguaaaacuacugguccuguuauguauauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccagguuauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacagaaauuugcuauggcugacggggaagagugguuuguacccaaaccugagcaaguccuaugcaaacaacaaagagaaagaaguccuuguacuaugggguguucaucacccgccuaacauagggguccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaagagugcaaaauuaaggaugguuacaggacuaaggaacaucccauccauucaauccagggguuuguuuggagccauugccgguuucauugaagggggguggacuggaaugguagaugguugguaugguuaucaucaucagaaugagcaaggaucuggcuaugcugcagaucagaaaaguacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaguucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 38505 - RNA, 1698 nt, Artificial Sequence; identical to SEQ ID NO: 38504
  hemagglutinin__InfluenzaA__AEX34506

SEQ ID NO: 38506 - RNA, 1698 nt, Artificial Sequence; identical to SEQ ID NO: 38504
  hemagglutinin__InfluenzaA__AEX34517

SEQ ID NO: 38507 - RNA, 1698 nt, Artificial Sequence; identical to SEQ ID NO: 38504
  hemagglutinin__InfluenzaA__AEX34528

SEQ ID NO: 38508 - RNA, 1698 nt, Artificial Sequence; identical to SEQ ID NO: 38504
  hemagglutinin__InfluenzaA__AEX34539

SEQ ID NO: 38509 - RNA, 1698 nt, Artificial Sequence; identical to SEQ ID NO: 38504
  hemagglutinin__InfluenzaA__AEX34550

SEQ ID NO: 38510 - RNA, 1698 nt, Artificial Sequence; identical to SEQ ID NO: 38504
  hemagglutinin__InfluenzaA__AEX34561

SEQ ID NO: 38511 - RNA, 1698 nt, Artificial Sequence; identical to SEQ ID NO: 38504
  hemagglutinin__InfluenzaA__AEX34572

SEQ ID NO: 38512 - RNA, 1698 nt, Artificial Sequence; identical to SEQ ID NO: 38504
  hemagglutinin__InfluenzaA__AEX34583

SEQ ID NO: 38513 - RNA, 1698 nt, Artificial Sequence; identical to SEQ ID NO: 38504
  hemagglutinin__InfluenzaA__AEX34594

SEQ ID NO: 38514 - RNA, 1698 nt, Artificial Sequence; identical to SEQ ID NO: 38504
  hemagglutinin__InfluenzaA__AEX34605

SEQ ID NO: 38515 - RNA, 1698 nt, Artificial Sequence; identical to SEQ ID NO: 38504
  hemagglutinin__InfluenzaA__AEX34616

SEQ ID NO: 38516 - RNA, 1698 nt, Artificial Sequence; identical to SEQ ID NO: 38504
  hemagglutinin__InfluenzaA__AEX34627

SEQ ID NO: 38517 - RNA, 1698 nt, Artificial Sequence; identical to SEQ ID NO: 38504
  hemagglutinin__InfluenzaA__AEX34638

SEQ ID NO: 38518 - RNA, 1698 nt, Artificial Sequence
  hemagglutinin__InfluenzaA__AEX34650
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugugaauuacugauuuccaaggaaucaugguccuacauuguagaaacaccaaauccugagaauggaacauguuacccaggguauuucgccgacuaugaggaacugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauagggaaccaaaggucccucuaucauacagaaaaugcuuaugucucuguaguaucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccccagggagcuauaaacagcagucuuccuuuccagaauguacacccagucacaauaggagaguguccaaaguaugucaggagugcaaaauugaggaugguuacaggacuaaggaacaucccauccauucaauccagagguuuguuuggagccauugccgguuucauugaagggggguggacuggaaugguagaugguugguaugguuaucaucaucagaaugagcaaggaucuggauaugcugcagaucaaaaaagcacacagaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaguauucugaagaaucaaaguuaaacagggagaaaauugauggagugaaauuggaaucaaugggagucuaucagauucuggcgauauacucaacagucgccaguucccugguucuuuuggucucccugggggcaaucagcuucuggauguguuccaaugggucuuugcaguguagaauaugcaucuaa

SEQ ID NO: 38519 - RNA, 1698 nt, Artificial Sequence
  hemagglutinin__InfluenzaA__AEX34661
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaagguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauucgaggcaaauggaaaucuaauagcaccaagguuugcuuucgcacugaguagaggcuuuggaucaggaaucaucaccucaaaugcaccaauggaugaaugugaugcgaagugucaaacaccucaaggagcuauaaacagcagccuuccuuuccagaauguacacccugucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaaaaaggugaauucuguaauugagaaaaugaacacucaauucacagcugugggcaaagaauucagcaaauuggagagaaggauggaaaacuuaaauaagaaaguugaugauggguuucuagacauuuggacauauaaugcagaauuguugguucuacuggaaaaugaaaggacuuuggauuuccaugacuccaacgugaagaaccuguaugagaaagugaaaagccaauuaaagaauaaugccaaagaaauaggaaacgggugcuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 38520 - RNA, 1698 nt, Artificial Sequence
  hemagglutinin__InfluenzaA__AEX34672
augaaaguaaaacuacugguucuguuaugcacauuuacagcuacauaugcagacacaauauguauaggcuaccaugccaacaacucaaccgacacuguugacacaguacuugauaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugagagauucgaaauauuccccaaagaaagcucauggcccaaccacaccacaaccggaguaucagcaucaugcucccaugauggggaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauagguguccaaagggcccucuaucauacagaaaaugcuuaugucucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaaggaggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38521 - RNA, 1698 nt, Artificial Sequence
  hemagglutinin__InfluenzaA__AEX34683
augaaaguaaaacuacugguucuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugagagauucgaaauauuccccaaagaaagcucauggcccuaccacaccacaaccggaguaucagcaucaugcucccauaauggggaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaaggaggguggacuggaaugguagaugguugguaugguuaucaucaucagaaugagcaaggauuuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38522 - RNA, 1698 nt, Artificial Sequence
  hemagglutinin__InfluenzaA__AEX34757
augaaaguaaaacuacugguucuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugagagauucgaaauauuccccaaagaaagcucauggcccaaccacaccacaaccggaguaucagcaucaugcucccauaaugggggaagcaguuuuuacaaaaauuugcuauggcugacgaggaagaaugguuuguacccaaaccugagcaaguccuaugcaaacaacaaagagaaagaaguccuugugcuaugggguguucaucacccgccuaacauaggugaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaaggaggguggacuggaaugguagaugguugguaugguuaucaucaucagaaugagcaaggaucuggcuaugcugcagaucaaaaaagcacacaaaaugccauuaaugggauuacaaacaagguuaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguugaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38523 - RNA, 1698 nt, Artificial Sequence
  hemagglutinin__InfluenzaA__AEX34768
augaaaguaaaacuacugguucuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaacccugagaauggaacauguuacccagggcauuucgccgacuaugaggaacugagggagcaauugaguucaguaucuucauuugagagauucgaaauauuccccaaagacagcucauggcccaaccacaccacaaccggaguaucagcaucaugcucccauaauggggaaagcaguuuuuacaaaaauuugcuauggcugacggggaagaaugguuuguacccaaaucugagcaaguccuaugcaaacaacaaagagaaagaaguccuuguacuaugggguguucaucacccgccuaacauaggugaccaaagggcccucuaucauacagaaaaugcuuaugucucuguagugucuucacauuauagcagaaaauucaccccagaaauagccaaaagacccaaaguaagagaucaaggaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaaggaggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38524 - RNA, 1698 nt, Artificial Sequence
  hemagglutinin__InfluenzaA__AEX34779
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaacgcaguuuuuacagaaauuugcuauggcugacggggaagaaugguuuguacccaaaccugagcaaguccuaugcaaacaacaaagaaaaagaaguccuuguacuaugggguguucaucacccgccaaacauagguaaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacgccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38525 - RNA, 1698 nt, Artificial Sequence
  hemagglutinin__InfluenzaA__AEX34790
augaaaguaaaacuacugguccuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaaaaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguauccgcaucaugcucccauaauggggaaagcagcuuuuacaaaaauuugcuauggcugacgggaaagaaugguuuguacccaaaccugagcaaguccuaugcaaacaacaaggagaaagaaguccucguacuaugggguguucaucacccgccaaacauaggugaccaaaugacccucuaccauaaagaaaaugcuuaugucucuguagugucuucacauuauagcagaaaauucaccccagaaauagccaaaagacccaaggugagagaucaagaagggagaaucaacuacuacuggacucugcuugaacccggggauacaauaauauuugaggcaaguggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucagaagugcaaaauuaaggaugguuacaggacuaaggaacaucccauccauucaauccagagguuuguuuggagccauugcugguuucauugaagggggguggacuggaaugguagaugguugguaugguuaucaucaccagaaugagcaaggaucuggcuaugcugcagaucaaaaaagcacacaaaaugccauuaaugggaucacaaacaaggugaauucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugagagaacuuuggauuuccaugacuccaaugugaagaauuuguaugagaaaguaaaaaaccaauuaaaaaauaaugccaaagaaauaggaaauggguguuuugaauuuuaucacaaguguaacgaugaaugcauggagaguguaaaaaauggaacuuaugacuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38526 - RNA, 1698 nt, Artificial Sequence
  hemagglutinin__InfluenzaA__AEX34801
augaaaguaaaacuacugguucuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaaaaccaaauccugagaauggagcauguuacccagggcauuucgccgacuaugaggaacugagggagcaauugaguucuguaucuucauuuaagagguucgaaauauuccccaaagaaagcucauggcccaaccacaccguaaccggaguauccgcaucaugcucccauaauggggaaagcagcuuuuacaaaaauuugcuauggcugacgggaaagaaugguuuguacccaaaccugagcaaguccuaugcaaacaacaaggagaaagaaguccucguacuaugggguguucaucacccgccaaacauaggugaccaaaugacccucuaccauaaagaaaaugcuuaugucucuguagugucuucacauuauagcagaaaauucaccccagaaauagccaaaagacccaaggugagagaucaagaagggagaaucaacuacuacuggacucugcuugaacccggggauacaauaauauuugaggcaaguggaaaucuaauagcgccaagauaugcuuucgcacugaguagaggcuuuggaucaggaaucaucaacucagaugcaccaauggaugaaugugaugcgaagugccaaacaccucagggagcuauaaacagcagucuuccuuuccagaauguacacccagucacaauaggagaauguccaaaguaugucagaagugcaaaauuaaggaugguuacaggacuaaggaacaucccauccauucaauccagagguuuguuuggagccauugcugguuucauugaagggggguggacuggaaugguagaugguugguaugguuaucaucaccagaaugagcaaggaucuggcuaugcugcagaucaaaaaagcacacaaaaugccauuaaugggaucacaaacaaggugaauucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugagagaacuuuggauuuccaugacuccaaugugaagaauuuguaugagaaaguaaaaaaccaauuaaaaaauaaugccaaagaaauaggaaauggguguuuugaauuuuaucacaaguguaacgaugaaugcauggagaguguaaaaaauggaacuuaugacuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38527 - RNA, 1698 nt, Artificial Sequence
  hemagglutinin__InfluenzaA__AEX34812
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacacuguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggauggucacaggacuaaggaacaucccauccauucaauccagagguuuguuuggagcuauugccgguuucauugaagggggguggacuggaaugguagaugguugguaugguuaucaucaucagaaugagcaaggaucuggcuaugcugcagaucaaaaaagcacacaaaaugccauugaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38528 - RNA, 1698 nt, Artificial Sequence
  hemagglutinin__InfluenzaA__AEX34834
augaaaguaaaacuacugguucuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugaauuccaaggagucaugguccuacauuguagaaaaaccaaauccugagaauggaacauguuacccagggcauuucgccgacuaugaggaacugagggagcaauugaguucaguaucuucauuuaagagguucgaaauauuccccaaagaaagcucauggcccaaccacaccguaaccggaguauccgcaucaugcucccauaauggggaaagcagcuuuuacaaaaauuugcuauggcugacgggaaagaaugguuuguacccaaaccugagcaaguccuaugcaaacaacaaggagaaagaaguccucguacuaugggguguucaucacccgccaaacauaggugaccaaaugacccucuaccauaaagaaaaugcuuaugucucuguagugucuucacauuauagcagaaaauucaccccagaaauaaccaaaagacccaaggugagagaucaagaagggagaaucaacuacuacuggacucugcuugaacccggggauacaauaauauuugaggcaaguggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucagaagugcaaaauuaaggaugguuacaggacuaaggaacaucccauccauucaaucuagagguuuguuuggagccauugcugguuucauugaagggggguggacuggaaugguagaugguugguaugguuaucaucaccagaaugagcaaggaucuggcuaugcugcagaucaaaaaagcacacaaaaugccauuaaugggaucacaaacaaggugaauucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugagagaacuuuggauuuccaugacuccaaugugaagaauuuguaugagaaaguaaaaaaccaauuaaaaaauaaugccaaagaaauaggaaauggguguuuugaauuuuaucacaaguguaacgaugaaugcauggagaguguaaaaaauggaacuuaugacuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38529 - RNA, 1698 nt, Artificial Sequence
  hemagglutinin__InfluenzaA__AEX34845
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugguucccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaccaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugaaggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38530 - RNA, 1698 nt, Artificial Sequence; identical to SEQ ID NO: 38525
  hemagglutinin__InfluenzaA__AEX34856

SEQ ID NO: 38531 - RNA, 1698 nt, Artificial Sequence
  hemagglutinin__InfluenzaA__AEX34867
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacugcaauuggguaacugcagcguugccggguggaucuuaggaaacccagaaugcgaauuacugguuuccaaggagucaugguccuacauuguagaaaaaccaaauccugagaauggaacauguuacccagggcauuucgcugacuaugaggaacugagggagcaauugauuucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggaaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugaaggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38532 - RNA, 1698 nt, Artificial Sequence; identical to SEQ ID NO: 38525
  hemagglutinin__InfluenzaA__AEX34878

SEQ ID NO: 38533 - RNA, 1698 nt, Artificial Sequence
  hemagglutinin__InfluenzaA__AEX34889
augaaaguaaaucuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugugaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugccuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38534 - RNA, 1698 nt, Artificial Sequence
  hemagglutinin__InfluenzaA__AEX34900
augaaaguaaaacuacugguccuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaaaaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguauccgcaucaugcucccauaauggggaaagcagcuuuuacaaaaauuugcuauggcugacgggaaagaaugguuuguacccaaaccugagcaaguccuaugcaaacaacaaggagaaagaaguccucguacuaugggguguucaucacccgccaaacauaggugaccaaaugacccucuaccauaaagaaaaugcuuaugucucuguagugucuucacauuauagcagaaaauucaccccagaaauagccaaaagacccaaggugagagaucaagaagggagaaucaacuacuacuggacucugcuugaacccggggauacaauaauauuugaggcaaguggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucagaagugcaaaauuaaggaugguuacaggacuaaggaacaucccauccauucaauccagagguuuguuuggagccauugcugguuucauugaagggggguggacuggaaugguagaugguugguaugguuaucaucaccagaaugagcaaggaucuggcuaugcugcagaucaaaaaagcacacaaaaugccauuaauggggucacaaacaaggugaauucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugagagaacuuuggauuuccaugacuccaaugugaagaauuuguaugagaaaguaaaaaaccaauuaaaaaauaaugccaaagaaauaggaaauggguguuuugaauuuuaccacaaguguaacgaugaaugcauggagaguguaaaaaauggaacuuaugacuauccaaaauauuccgaagaaucaaaguuaagcagggagaaaauugauggaguggaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38535 - RNA, 1698 nt, Artificial Sequence
  hemagglutinin__InfluenzaA__AEX34911
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuucccaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauugggaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38536 - RNA, 1698 nt, Artificial Sequence
  hemagglutinin__InfluenzaA__AEX34922
augaaaguaaaacuacugguccuguuaugcacauuuacagcuacauaugcagacacaauauguauaggcuaccaugccaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauugcugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaagauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaagaaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuuggauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38537 - RNA, 1698 nt, Artificial Sequence
  hemagglutinin__InfluenzaA__AEX34933
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuauacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuagucucccugggggcaaucagcuucuggauguguuccaaugggucuuugcaguguagaauaugcaucuaa

SEQ ID NO: 38538 - RNA, 1698 nt, Artificial Sequence
  hemagglutinin__InfluenzaA__AEX34944
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaaccuggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagagugcccaaaguaugucaggagugcaaaauuaaggaugguuacaggacuaaggaacaucccauccauucaauccagaggucuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38539 - RNA, 1698 nt, Artificial Sequence
  hemagglutinin__InfluenzaA__AEX34955
augaaagcaaaacuacugguccuguuaugcaccuuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaaugggacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaaccuggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagagugcccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38540 - RNA, 1698 nt, Artificial Sequence
  hemagglutinin__InfluenzaA__AEX34966
augaaaguaaaacuacugguccuauuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaaccuggggauacaauaauguuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagagugcccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38541 - RNA, 1698 nt, Artificial Sequence; identical to SEQ ID NO: 38540
  hemagglutinin__InfluenzaA__AEX34977

SEQ ID NO: 38542 - RNA, 1698 nt, Artificial Sequence; identical to SEQ ID NO: 38540
  hemagglutinin__InfluenzaA__AEX34988

SEQ ID NO: 38543 - RNA, 1698 nt, Artificial Sequence; identical to SEQ ID NO: 38525
  hemagglutinin__InfluenzaA__AEX34999

SEQ ID NO: 38544 - RNA, 1698 nt, Artificial Sequence; identical to SEQ ID NO: 38540
  hemagglutinin__InfluenzaA__AEX35010

SEQ ID NO: 38545 - RNA, 1698 nt, Artificial Sequence; identical to SEQ ID NO: 38540
  hemagglutinin__InfluenzaA__AEX35032

SEQ ID NO: 38546 - RNA, 1698 nt, Artificial Sequence; identical to SEQ ID NO: 38540
  hemagglutinin__InfluenzaA__AEX35043

SEQ ID NO: 38547 - RNA, 1698 nt, Artificial Sequence
  hemagglutinin__InfluenzaA__AEX35054
augaaaguaaaacuacugguccuauuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaaccuggggauacaauaauguuugaggcaaauggaaaucuaauagcgccaagauaugcuuucgcacugaauagaggcuuuggaucaggaaucaucaacucaaaugcaccaauggauaaaugugaugcgaagugccaaacaccucagggagcuauaaacagcagucuuccuuuccagaacguacacccagucacaauaggagagugcccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaacgugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38548 - RNA, 1698 nt, Artificial Sequence
  hemagglutinin__InfluenzaA__AEX35065
augaaaguaaaacuacugguccuauuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaucaaaaggcccucuaucauacagaaaaugcuuauguuucuguaguaucuucacauuauagcagaaaauucaccccagaaauagccaaaagacccaaaguaagagaucaagaaggaagaaucaacuacuacuggacucugcuugaaccuggggauacaauaauguuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagagugcccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38549 - RNA, 1698 nt, Artificial Sequence; identical to SEQ ID NO: 33009
  hemagglutinin__InfluenzaA__AEX35076

SEQ ID NO: 38550 - RNA, 1698 nt, Artificial Sequence
  hemagglutinin__InfluenzaA__AEX35087
augaaaguaaaacuacugguucuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaaaaccaaauccugagaauggaacauguuacccagggcauuucgccgacuaugaggaacugagggagcaauugaguucaguaucuucauuuaagagguucgaaauauuccccaaagaaagcucauggcccaaccacaccguaaccggaguauccgcaucaugcucccauaauggggaaagcagcuuuuacaaaaauuugcuauggcugacgggaaagaaugguuuguacccaaaccugagcaaguccuaugcaaacaacaaggagaaagaaguccucguacuaugggguguucaucacccgccaaacauaggugaccaaaugacccucuaccauaaagaaaaugcuuaugucucuguagugucuucacauuauagcagaaaauucaccccagaaauagccaaaagacccaaggugagagaucaagaagggagaaucaacuacuacuggacucugcuugaacccggggauacaauaauauuugaggcaaguggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucagaagugcaaaauuaaggaugguuacaggacuaaggaacaucccauccauucaauccagagguuuguuuggagccauugcugguuucauugaaggaggguggacuggaaugguagaugguugguaugguuaucaucaccagaaugagcaaggaucuggcuaugcugcagaucaaaaaagcacacaaaaugccauuaaugggaucacaaacaaggugaauucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugagagaacuuuggauuuccaugacuccaaugugaagaauuuguaugagaaaguaaaaaaccaauuaaaaaauaaugccaaagaaauaggaaauggguguuuugaauuuuaucacaaguguaacgaugaaugcauggagaguguaaaaaauggaacuuaugacuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38551 - RNA, 1698 nt, Artificial Sequence
  hemagglutinin__InfluenzaA__AEX35098
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguaaugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacuauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38552 - RNA, 1698 nt, Artificial Sequence
  hemagglutinin__InfluenzaA__AEX35109
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucaaccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38553 - RNA, 1698 nt, Artificial Sequence
  hemagglutinin__InfluenzaA__AEX35120
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccauaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuugugcuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucgagaaggaagaaucaacuacuacuggacucugcuugaaccuggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaaugaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38554 - RNA, 1698 nt, Artificial Sequence
  hemagglutinin__InfluenzaA__AEX35131
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguaaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38555 - RNA, 1698 nt, Artificial Sequence; identical to SEQ ID NO: 38554
  hemagglutinin__InfluenzaA__AEX35142

SEQ ID NO: 38556 - RNA, 1698 nt, Artificial Sequence
  hemagglutinin__InfluenzaA__AEX35153
augaaaguaaaacuacugguccuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaaaaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguauccgcaucaugcucccauaauggggaaagcagcuuuuacaaaaauuugcuauggcugacgggaaagaaugguuuguacccaaaccugagcaaguccuaugcaaacaacaaggagaaagaaguccucguacuaugggguguucaucacccgccaaacauagguaaccaaaugacccucuaccauaaagaaaaugcuuaugucucuguagugucuucacauuauagcagaaaauucaccccagaaauagccaaaagacccaaggugagagaucaagaagggagaaucaacuacuacuggacucugcuugaacccggggauacaauaauauuugaggcaaguggaaaucuaauagcgccaagauaugcuuucgcacugaguagaggcuuuggaucaggaaucaucaacucaaaugcaccaauggaugaaugugaugcgaagugccaaacaccucagggagcuauaaacagcaaucuuccuuuccagaauguacacccagucacaauaggagaauguccaaaguaugucagaagugcaaaauuaaggaugguuacuggacuaaggaacaucccauccauucaauccagagguuuguuuggagccauugcugguuucauugaagggggguggacuggaaugguagaugguugguaugguuaucaucaccagaaugagcaaggaucuggcuaugcugcagaucaaaaaagcacacaaaaugccauuaaugggaucacaaacaaggugaauucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugagagaacuuuggauuuccaugacuccaaugugaagaguuuguaugagaaaguaaaaaaccaauuaaaaaauaaugccaaagaaauaggaaauggguguuuugaauuuuaucacaaguguaacgaugaaugcauggagaguguaaaaaauggaacuuaugacuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38557 - RNA, 1698 nt, Artificial Sequence
  hemagglutinin__InfluenzaA__AEX35164
augaaaguaaaacuacugguccuguuaugcgcauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguguccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcggugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaguuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38558 - RNA, 1698 nt, Artificial Sequence
  hemagglutinin__InfluenzaA__AEX35175
augaaaguaaaacuacugguucuguuauguacauuuacagcuacauaugcagacacaauauguauaggcuaccaugccaacaacucaaccgacacuguugacacaguacuugagaagaaugugacagugacacacucugucgaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaacagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauucgaggcaaauggaaaucuaauagcaccaagguuugcuuucgcacugaauagaggcuuuggaucaggaaucaucaccucaaaugcaccaauggauggaugugaugcgaagugucaaacaccucaaggagcuauaaacagcagccuuccuuuccagaauguacacccugucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaagaaaguugaugauggguuucuagacauuuggacauauaaugcagaauuguugguucuacuggaaaaugaaaggacuuuggauuuccaugacuccaacgugaagaaccuguaugagaaagugaaaagccaauuaaagaauaaugccaaagaaauaggaaacgggugcuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 38559 - RNA, 1698 nt, Artificial Sequence
  hemagglutinin__InfluenzaA__AEX35186
augaaaguaaaacuacugguucuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugagagauucgaaauauuccccaaagaaagcucauggcccaaccacaccacaaccggaguaucagcaucaugcucccauaauggggaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauagguaaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaaggaggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38560 - RNA, 1698 nt, Artificial Sequence; identical to SEQ ID NO: 38559
  hemagglutinin__InfluenzaA__AEX35197

SEQ ID NO: 38561 - RNA, 1698 nt, Artificial Sequence
  hemagglutinin__InfluenzaA__AEX35208
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuauuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38562 - RNA, 1701 nt, Artificial Sequence
  hemagglutinin__InfluenzaA__AEX35219
augaagacuaucauugcuuugagcuacauuuuaugucugguuuucgcucaaaaacuucccggaaaugacaacagcacggcaacgcugugccuggggcaucaugcaguaccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacaguaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucagaauguaaacaggaucacauauggggccugucccagguauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaagagcacucaagcagcaaucaaccaaaucaacgggaaacugaauagguuaaucgggaaaacgaacgagaaauuccaucagauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggagaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccaugucauguuuuuugcuuuguguuguuuugcugggguucaucaugugggccugccaaaaaggcaacauuaggugcaacauuugcauuuga

SEQ ID NO: 38563 - RNA, 1698 nt, Artificial Sequence; identical to SEQ ID NO: 38504
  hemagglutinin__InfluenzaA__AEX35230

SEQ ID NO: 38564 - RNA, 1701 nt, Artificial Sequence
  hemagglutinin__InfluenzaA__AEX35241
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaucuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccauuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaggacaaagaagcaacuuagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38565 - RNA, 1698 nt, Artificial Sequence; identical to SEQ ID NO: 38504
  hemagglutinin__InfluenzaA__AEX35263

SEQ ID NO: 38566 - RNA, 1698 nt, Artificial Sequence; identical to SEQ ID NO: 38504
  hemagglutinin__InfluenzaA__AEX35274

SEQ ID NO: 38567 - RNA, 1701 nt, Artificial Sequence; identical to SEQ ID NO: 38456
  hemagglutinin__InfluenzaA__AEX35285

SEQ ID NO: 38568 - RNA, 1701 nt, Artificial Sequence
  hemagglutinin__InfluenzaA__AEX35296
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugccugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaacguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38569 - RNA, 1701 nt, Artificial Sequence
  hemagglutinin__InfluenzaA__AEX35307
augaagacuaucauugcuuugagcuacauucuaugucugguuuucgcucaaaaaauucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuagaucacuaguugccucaucuggcacacuggaguuuaacaaugaaagcuucaauuggacuggagucacucagaauggaacaagcucugcuugcaaaaggagaucuaauaaaaguuucuuuaguagauugaauugguugacccauuuaaaauacaaauacccagcauugaacgugacuaugccaaacaaugaaaaauuugacaaauuguacauuugggggguucaccacccggguacggacagugaucaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaucucgagaaauauguugaggacacuaaaauagaucucuggucauacaacgcggagcuucuuguugcccuggagaaccaacauacaauugaucuaacugacucagaaaugaacaaacuguuugaaaggacaaagaagcaacugagggaaaaugcugaggauaugggcaaugguuguuucaaaauauaccacaaaugugacaaugccuguauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 38570 - RNA, 1701 nt, Artificial Sequence; identical to SEQ ID NO: 38568
  hemagglutinin__InfluenzaA__AEX35318

SEQ ID NO: 38571 - RNA, 1701 nt, Artificial Sequence
  hemagglutinin__InfluenzaA__AEX35329
augaagacuaucauugcuuugagcuacuuucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccauuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucuaaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaggacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38572 - RNA, 1701 nt, Artificial Sequence
  hemagglutinin__InfluenzaA__AEX35340
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccauuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucuaaaauuggcaacagggaugcgaaauguaccagagaaacaaacuagaggcauauuuggcgcaaucgcagguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaggacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38573 - RNA, 1701 nt, Artificial Sequence; identical to SEQ ID NO: 38465
  hemagglutinin__InfluenzaA__AEX35351

SEQ ID NO: 38574 - RNA, 1701 nt, Artificial Sequence; identical to SEQ ID NO: 38465
  hemagglutinin__InfluenzaA__AEX35362

SEQ ID NO: 38575 - RNA, 1701 nt, Artificial Sequence; identical to SEQ ID NO: 38456
  hemagglutinin__InfluenzaA__AEX35373

SEQ ID NO: 38576 - RNA, 1701 nt, Artificial Sequence
  hemagglutinin__InfluenzaA__AEX35384
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugagcgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagaaccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaacguaccagagaaacaaacuagagguauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38577 - RNA, 1701 nt, Artificial Sequence
  hemagglutinin__InfluenzaA__AEX35395
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucaaauccuugauggagaaaacugcacacuaauagaugcucuauugggagacccucagugugauggcuuccaaaauaagaaauggaaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaauagcacagggaaucuaauugcuccucgggguuacuucaaaauacggagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38578 - RNA, 1701 nt, Artificial Sequence; identical to SEQ ID NO: 38456
  hemagglutinin__InfluenzaA__AEX35406

SEQ ID NO: 38579 - RNA, 1701 nt, Artificial Sequence; identical to SEQ ID NO: 38456
  hemagglutinin__InfluenzaA__AEX35417

SEQ ID NO: 38580 - RNA, 1701 nt, Artificial Sequence
  hemagglutinin__InfluenzaA__AEX35428
augaagacuaucauugcuuugagcuacauuuuaugucugguuuucgcucaaaaacuucccggaaaugacaacagcacggcaacgcugugccuugggcaccaugcaguaccaaacggaacgcuagugaaaacaaucacgaaugaccaaauugaagugacuaaugcuacugagcugguucagaguuccucaacagguggaauaugcgacaguccucaucagauccuugauggagaaaacugcacacuaauagaugcucuauugggagacccucauugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagauccgauaaaaguuucuuuaguagauugaauugguugcaccaauuaaaauacaaauacccagcauugaacgugacuaugccaaacaaugaaaaauuugacaaauuguacauuugggggguucaccacccggguacggacagugaccaaaucagccuauaugcucaagcaucagggagaaucacagucucuaccaaaagaagccaacaaacuguaaucccgaauaucggaucuagacccaggguaagggaugucuccagcagaauaagcaucuauuggacaauaguaaaaccgggagacauacuuuuuauuaacagcacagggaaucuaauugcuccucgggguuacuucaaaauacgaagugggaaaagcucaauaaugagaucagaugcacccauugacaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuugcugggguucaucaugugggccugccaaaaaggcaacauuaggugcaacauuugcauuuga

SEQ ID NO: 38581 - RNA, 1698 nt, Artificial Sequence
  hemagglutinin__InfluenzaA__AEX35439
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagauuugcuuucgcauugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauugaggaugguuacaggacuaaggaacaucccauccauucaauccagagguuuguuuggagccauugccgguuucauugaagggggguggacuggaaugguagaugguugguaugguuaucaucaucagaaugagcaaggaucuggauaugcugcagaucaaaaaagcacacagaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaguauucugaagaaucaaaguuaaacagggagaaaauugauggagugaaauuggaaucaaugggagucuaucagauucuggcgauauacucaacagucgccaguucccugguucuuuuggucucccugggggcaaucagcuucuggauguguuccaaugggucuuugcaguguagaauaugcaucuaa

SEQ ID NO: 38582 - RNA, 1701 nt, Artificial Sequence
  hemagglutinin__InfluenzaA__AEX35450
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaaacuucaauuggacuggagucacucaaaauggaacaagcucugcuugcaaaaggagauccaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuugagaaccaacauacaauugaucuaacugacucagaaaugaacaaacuguuugaaagaacaaagaagcaacugagggaaaaugcugaggauaugggcaaugguuguuucaaaauauaccauaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38583 - RNA, 1701 nt, Artificial Sequence
  hemagglutinin__InfluenzaA__AEX35461
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcuggugcagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacccaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38584 - RNA, 1701 nt, Artificial Sequence
  hemagglutinin__InfluenzaA__AEX35472
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugaugacuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccaggguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaccucaaaagcacucaagcagcaaucaaucaaaucaaugggaagcugaauagguugaucgggaaaaccaacgagaaauuccaucagauugaaaaagaauucucagaaguagaagggagaauucaagaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 38585 - RNA, 1701 nt, Artificial Sequence
  hemagglutinin__InfluenzaA__AEX35483
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcuggugcagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacccaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuugucgcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38586 - RNA, 1701 nt, Artificial Sequence
  hemagglutinin__InfluenzaA__AEX35494
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaucaaauugaaguuacuaaugcuacugagcugguucagaguuccucaacagguggaauaugcgacaguccucaucagauccuugauggagaaaacugcacacuaauagaugcucuauugggagacccucagugugauggccuccaaaauaagaaaugggaucuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaaugggacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucaaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugauggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38587 - RNA, 1701 nt, Artificial Sequence
  hemagglutinin__InfluenzaA__AEX35505
augaagacuaucauugcuuugagcuacauucuaugucugguuuucgcucaaaaacuucccgggaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugaugacuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccaggguaaggaauauccccagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38588 - RNA, 1701 nt, Artificial Sequence
  hemagglutinin__InfluenzaA__AEX35516
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaucaaauugaaguuacuaaugcuacugagcugguucagaguuccucaacagguggaauaugcgacaguccucaucagauccuugauggagaaaacugcacacuaauagaugcucuauugggagacccucagugugauggccuccaaaauaagaaaugggaucuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaaugggacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucaaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38589 - RNA, 1701 nt, Artificial Sequence
  hemagglutinin__InfluenzaA__AEX35527
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugucucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacguaacuaugccaaacaaugaacaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaaacaacugagggaaaaugcugaggauaugggcaaugguuguuucaaaauauaccacaaaugugacaaugccugcauagggucaaucagaaauggaacuuaugaucaugauguauacagagaugaagcauuaaacaaccgguuccagaucaaagguguugagcugaagucaggauacaaagauuggauccuuuggauuuccuuugccauaucauguuuuuugcuuuguguugcuuuguugggguucaucaugugggccugccaaaaaggcaacauuaggugcaacauuugcauuuga

SEQ ID NO: 38590 - RNA, 1701 nt, Artificial Sequence
  hemagglutinin__InfluenzaA__AEX35549
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggggauccaauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucagccuauaugcucaagcaucaggaaaaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauugacaaaugcaauucugaaugcaucacuccaaauggaagcauucccaaugacaaaccauuucaaaauguaaacaagaucacauauggggccugucccagauauguuaagcaaaacacucugaaauuggcaacagggaugcgaaauguaccagagaaacaaaccagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauccaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccauaaaugugacaaugccugcauagggucaaucagaaauggaacuuaugaccaugauguauacagagaugaagcauuaaacaaccgauuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38591 - RNA, 1701 nt, Artificial Sequence
  hemagglutinin__InfluenzaA__AEX35560
augaagacuaucauugcuuugagcuacauucuaugucuaguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacucuaauagaugcucuauugggagacccucagugugauggcuuccaaaauaagaaaugggaccuuuuuguugaacgcagcaaagccuacagcaacuguuacccuuaugaugugccggauuaugucucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaacaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucggggguacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaauugcggguuucauagaaaaugguugggagggaaugguggaugguugguacgguuucaggcaucaaaauucugugggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaucaugauguauacagagaugaagcauuaaacaaccgguuccagaucaaagguguugagcugaagucaggauacaaagauuggauccuauggauuuccuuugccauaucauguuuuuugcuuuguguugcuuuguuaggguucaucaugugggccugccaaaaaggcaacauuaggugcaacauuugcauuuga

SEQ ID NO: 38592 - RNA, 1701 nt, Artificial Sequence
  hemagglutinin__InfluenzaA__AEX35571
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugagguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcagagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcgucgagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38593 - RNA, 1701 nt, Artificial Sequence
  hemagglutinin__InfluenzaA__AEX35582
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacgcaagcagcaaucaaucaaaucaaugggaagcugaauagguugaucgggaagaccaacgagaaauuccaucagauugaaaaagaauucucagaaguagaagggagaauucaagaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38594 - RNA, 1701 nt, Artificial Sequence
  hemagglutinin__InfluenzaA__AEX35593
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcuggugcagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacccaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcaccccuuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38595 - RNA, 1701 nt, Artificial Sequence
  hemagglutinin__InfluenzaA__AEX35604
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugaugacuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccaggguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaccucaaaagcacucaagcagcaaucaaucaaaucaaugggaagcugaauagguugaucgggaaaaccaacgagaaauuccaucagauugaaaaagaauucucagaaguagaagggagaauucaagaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38596 - RNA, 1701 nt, Artificial Sequence
  hemagglutinin__InfluenzaA__AEX35615
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguucuucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuugaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauauugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38597 - RNA, 1701 nt, Artificial Sequence
  hemagglutinin__InfluenzaA__AEX35626
augaagacuaucauugcuuugagcuacauucuaugucugguuuucgcucaaaaacuuccuggaaaugacaacagcacggcaacgcugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38598 - RNA, 1701 nt, Artificial Sequence
  hemagglutinin__InfluenzaA__AEX35637
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacgggagucacucaaaauggaacaagcucugcuugcaaaaggggaucugauaacaguuucuuuaguaaauugaauugguugacccacuuaaaauucaaauacccagcauugaacgugacuaugccaaacaaugaaaaauuugacaaauuguacauuugggggguucaccacccggguacggacaaugaccaaaucuucccguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcagaacacccugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcagagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggcuacaaagauuggauccuauggauuuccuuugccauaucauguuuuuugcuuuguguugcuuuguugggguucaucaugugggccugccaaaaaggcaacauuaggugcaacauuugcauuuaa

SEQ ID NO: 38599 - RNA, 1701 nt, Artificial Sequence; identical to SEQ ID NO: 33021
  hemagglutinin__InfluenzaA__AEX35648

SEQ ID NO: 38600 - RNA, 1701 nt, Artificial Sequence
  hemagglutinin__InfluenzaA__AEX36102
augaagacuaucauugcuuugagcuacauucuaugucugguuuucgcucaaaaacuucccggaaauaacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcauuuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugagaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38601 - RNA, 1701 nt, Artificial Sequence
  hemagglutinin__InfluenzaA__AEX36113
augaagacuauuauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuagaucacuaguugccucauccggcacacuggaguuuaacaaugaaagcuucaauuggacuggagucacucaaaacggaacaagcucugcuugcauaaggagaucuaauaacagcuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcggcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuucauuugccauaucauguuuuuugcuuuguguugcuuuguugggguucaucaugugggccugccaaaaaggcaacauuaggugcaacauuugcauuuga

SEQ ID NO: 38602 - RNA, 1701 nt, Artificial Sequence
  hemagglutinin__InfluenzaA__AEX36124
augaagacuaucauugcuuugagcuacauucuaugucugguuuucgcucaaaaacuuccuggaaaugacaacagcacggcaacgcugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaaguacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38603 - RNA, 1701 nt, Artificial Sequence
  hemagglutinin__InfluenzaA__AEX36146
augaagacuaucauugcuuugagcuacauucuaugucugguucucgcucaaaaacuuccuggagaugacaacagcacggcaacgcugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38604 - RNA, 1701 nt, Artificial Sequence
  hemagglutinin__InfluenzaA__AEX36168
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucaaaauggaacaagcucugcuugcaaaaggggaucugauaacaguuucuuuaguagauugaauugguugacccacuuaaaauucaaauacccagcauugaacgugacuaugccaaacaaugaagaauuugacaaauuguacaucugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuaggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauaugucaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauaaguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaaaaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuuaagaucaagggcguugagcugaagucaggauacaaagauuggauccuauggauuuccuuugccauaucauguuuuuugcuuuguguugcuuuguugggguucaucaugugggccugccaaaaaggcaacauuaagugcaacauuugcauuuga

SEQ ID NO: 38605 - RNA, 1701 nt, Artificial Sequence; identical to SEQ ID NO: 38597
  hemagglutinin__InfluenzaA__AEX36179

SEQ ID NO: 38606 - RNA, 1701 nt, Artificial Sequence
  hemagglutinin__InfluenzaA__AEX36190
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauuccgaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguauugcuuuguugggguucaucaugugggccugccaaaaaggcaacauuaggugcaacauuugcauuuga

SEQ ID NO: 38607 - RNA, 1701 nt, Artificial Sequence; identical to SEQ ID NO: 38484
  hemagglutinin__InfluenzaA__AEX36201

SEQ ID NO: 38608 - RNA, 1701 nt, Artificial Sequence
  hemagglutinin__InfluenzaA__AEX36212
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaauaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38609 - RNA, 1701 nt, Artificial Sequence; identical to SEQ ID NO: 38482
  hemagglutinin__InfluenzaA__AEX36223

SEQ ID NO: 38610 - RNA, 1701 nt, Artificial Sequence
  hemagglutinin__InfluenzaA__AEX36234
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacgggagucacucaaaauggaacaagcucugcuugcaaaaggggaucugauaacaguuucuuuaguaaauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcagaacacccugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguugucucaaaauauaccacaaaugugacaaugccugcauaggaucaaucagaaauggaacuuaugaccaugauguauacagagaugaagcauuaaacaaccgguuccagaucaaaggcguugagcugaagucaggcuacaaagauuggauccuauggauuuccuuugccauaucauguuuuuugcuuuguguugcuuuguugggguucaucaugugggccugccaaaaaggcaacauuaggugcaacauuugcauuuaa

SEQ ID NO: 38611 - RNA, 1701 nt, Artificial Sequence
  hemagglutinin__InfluenzaA__AEX36245
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaaaccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38612 - RNA, 1701 nt, Artificial Sequence
  hemagglutinin__InfluenzaA__AEX36256
augaagacuaucauugcuuugagcuauauucuaugucugguuuucacucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggaaaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38613 - RNA, 1701 nt, Artificial Sequence
  hemagglutinin__InfluenzaA__AEX36267
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauccaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38614 - RNA, 1701 nt, Artificial Sequence
  hemagglutinin__InfluenzaA__AEX36289
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaauaagccaacaaacuguaaucccgaauaucggaucuagacccagaguaaggaauauccccagcagaauaagcaucuauuggacaauaguaaaaccgggagacauacuuuugauuaacagcacaggaaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuacaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaaguuaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38615 - RNA, 1701 nt, Artificial Sequence
  hemagglutinin__InfluenzaA__AEX36300
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaaaaaaugggaccuuuuuguugaacgcagcaaagccuacagcaacuguuacccuuaugaugugccggauuaugccucccuuaggucacuaguugccucauccggcacacuggaguuuagcaaugaaagcuucaauuggacuggagucacucaaaauggaacaagcucugcuugcaaaaggggaucuaauaacaguuucuuuaguaaauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaagauacgaagugggaaaagcucaauaaugagaucagaugcacccauuggcaaaugcaauucugaaugcaucacuccaaauggaagcauccccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugaacugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38616 - RNA, 1701 nt, Artificial Sequence
  hemagglutinin__InfluenzaA__AEX36311
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguucaacaaugaaagcuucaauugggcuggagucacucaaaauggaacaagcucugcuugcaaaaggggaucuaauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuaggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaaacaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38617 - RNA, 1701 nt, Artificial Sequence
  hemagglutinin__InfluenzaA__AEX36322
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuucccuuaugcucaagcaucaggaagaaucacagucucuaccaaaauaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagccgcaaucgaucaaaucaaugggaagcugaauagguugauugggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguauugcuuuguugggguucaucaugugggccugccaaaaaggcaacauuaggugcaacauuugcauuuga

SEQ ID NO: 38618 - RNA, 1701 nt, Artificial Sequence
  hemagglutinin__InfluenzaA__AEX36333
augaagacuaucauugcuuugagcuacauucuaugucugguuuucgcucaaaaacuucccggaauugacaacagcacggcaacgcugugucuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaaugcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugaugcauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38619 - RNA, 1701 nt, Artificial Sequence
  hemagglutinin__InfluenzaA__AEX36344
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaugccuacagcaacuguuacccuuaugaugugccggauuaugccucccuuaggucacuaguugccucauccggcacacuggaguuuaacaaugaaagcuucaauugggcuggagucacucaaaauggaacaagcucugcuugcaaaaggggaucuaauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuaggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagaaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38620 - RNA, 1701 nt, Artificial Sequence
  hemagglutinin__InfluenzaA__AEX36366
augaagacuaucauugcuuugagcuacauucuaugucugguuuucgcucaaaaacuuuccggaaaugacaacagcacggcaacgcugugccuugggcaccaugcaguaccaaacggaacgauagugaaaacaaucacgaaugaccagauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcauuuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcauaacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaucuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38621 - RNA, 1701 nt, Artificial Sequence; identical to SEQ ID NO: 38490
  hemagglutinin__InfluenzaA__AEX36377

SEQ ID NO: 38622 - RNA, 1701 nt, Artificial Sequence
  hemagglutinin__InfluenzaA__AEX36388
augaagacuaucauugcuuugagcuacauucuaugucugguuuucgcucaaaaacuuccgggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugccugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauuccuaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugauggaugguugguacgguuucaggcaucaaaauucugagggaauaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38623 - RNA, 1701 nt, Artificial Sequence
  hemagglutinin__InfluenzaA__AEX36399
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaacugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcauuuauuggacaauaguaaaaccgggagacauacuuuugauuaacagcacagggaaucuaauugcuccuagggguuauuucaaaauacgaagugggaaaagcucaauaaugagaucagaugcacccauuggcaaaugcaauucugaaugcauaacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcagguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38624 - RNA, 1701 nt, Artificial Sequence
  hemagglutinin__InfluenzaA__AEX36410
augaagacuauuauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcauuuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38625 - RNA, 1701 nt, Artificial Sequence
  hemagglutinin__InfluenzaA__AEX36421
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucaaugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38626 - RNA, 1701 nt, Artificial Sequence
  hemagglutinin__InfluenzaA__AEX36432
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagguccuugauggagaaaacugcacacuaauagaugcucuauugggagacccucaaugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38627 - RNA, 1701 nt, Artificial Sequence
  hemagglutinin__InfluenzaA__AEX36443
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggauaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38628 - RNA, 1701 nt, Artificial Sequence
  hemagglutinin__InfluenzaA__AEX36454
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggauaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 38629 - RNA, 1701 nt, Artificial Sequence
  hemagglutinin__InfluenzaA__AEX36465
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggagcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38630 - RNA, 1701 nt, Artificial Sequence
  hemagglutinin__InfluenzaA__AEX36476
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuucccguaugcucaagcaucaggaagaaucacagucucuaccaaaagaagccaacaaacuguaaucccgaauaucggaucuagacccagaauaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcgauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauacguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38631 - RNA, 1701 nt, Artificial Sequence
  hemagglutinin__InfluenzaA__AEX36487
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucuccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggagcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38632 - RNA, 1701 nt, Artificial Sequence
  hemagglutinin__InfluenzaA__AEX36498
augaagacuaucauugcuuugagcuacauucuaugucugguuuucgcucaaaaacuucccggaauugacaacagcacggcaacguugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38633 - RNA, 1701 nt, Artificial Sequence
  hemagglutinin__InfluenzaA__AEX36509
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuucccguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38634 - RNA, 1701 nt, Artificial Sequence
  hemagglutinin__InfluenzaA__AEX36520
augaagacuaucauugcuuugagcuacauucuaugucugguuuucgcucaaaaacuuccuggaaaugacaacagcacggcaacgcugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuaccccuaugaugugccggauuaugccucccuuaggucacuaguugccucauccggcacacuggaguuuaacaaugaaagcuucaauuggacuggagucacucaaaauggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcagguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38635 - RNA, 1701 nt, Artificial Sequence
  hemagglutinin__InfluenzaA__AEX36531
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggaccggagucacucaaaacggaacaagcucugcuugcauaaggagaucuaauaacaguuucuuuaguagauugaauugguugacccacuuaaaauucaaauacccagcauugaacguaacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaacucugaaugcaucacuccaaauggaagcauucccaaugacaaaccauuccaaaauguaaacaggaucacauacggggccugucccagauauguuaagcaaaacacucugaaauuggcaacagggaugcggaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugauaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuuuaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38636 - RNA, 1701 nt, Artificial Sequence
  hemagglutinin__InfluenzaA__AEX36542
augaagacuaucauugcuuugagcuacauucuaugucugguuuucgcucaaaaacuuccuggaaaugacaacagcacggcaacgcugugccuugggcaccaugcaguaccaaacggaacaauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcauaaggagaucuaauaacaguuucuuuaguagauugaauugguugacccacuuaaaauucaaauauccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcauuuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38637 - RNA, 1701 nt, Artificial Sequence; identical to SEQ ID NO: 38636
  hemagglutinin__InfluenzaA__AEX36553

SEQ ID NO: 38638 - RNA, 1701 nt, Artificial Sequence; identical to SEQ ID NO: 38636
  hemagglutinin__InfluenzaA__AEX36564

SEQ ID NO: 38639 - RNA, 1701 nt, Artificial Sequence
  hemagglutinin__InfluenzaA__AEX36575
augaagacuaucauugcuuugagcuacauucuaugucugguuuucgcucaaaaacuuccuggaaauggcaacagcacggcaacgcugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagagaacugcacacuaauagaugcucuauugggagacccucaaugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguuaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagauaucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38640 - RNA, 1701 nt, Artificial Sequence
  hemagglutinin__InfluenzaA__AEX36586
augaagacuaucauugcuuugagcuacauucuaugucugguuuucgcucaaaaacuuccuggaaaugacaacaacacggcaacgcugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagagaacugcacacuaauagaugcucuauugggagacccucaaugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguuaacagaaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcuaaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38641 - RNA, 1701 nt, Artificial Sequence
  hemagglutinin__InfluenzaA__AEX36597
augaagacuaucauugcuuugagcuacauucuaugucugguuuucgcucaaaaacuuccuggaaaugacaacagcauggcaacgcugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagagaacugcacacuaauagaugcucuauugggagacccucaaugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagagugaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguuaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaguagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38642 - RNA, 1701 nt, Artificial Sequence
  hemagglutinin__InfluenzaA__AEX36608
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuauccuuaugaugugccggauuaugccucccuuaggucacuaguugccucauccggcacacuggaguuuaacaaugaaaacuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaagauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuugagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaacgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38643 - RNA, 1701 nt, Artificial Sequence; identical to SEQ ID NO: 38465
  hemagglutinin__InfluenzaA__AEX36619

SEQ ID NO: 38644 - RNA, 1701 nt, Artificial Sequence
  hemagglutinin__InfluenzaA__AEX63617
auggaagcaaaauuauuuguauuauucugugcauucacugcacuaaaagcugacaccauuuguguaggcuaccaugccaacaauuccacagacacugucgacacaauacuggagaaaaaugugacuguuacccauucaguuaauuuacuggaaaacagccauaaugggaaacucugcagccugaauggaaagauccccuuacaacuggggaacugcaacguagcaggauggauccuuggcaacccaaaaugugacuugcugcucacagcgaauucguggucuuacauaauagagacuucaaauucaaaaaauggagcaugcuaccccggagaauucgcugauuaugaagaguuaaaggagcagcugaguacaguuucuucauuugaaagauuugaaauuuucccaaaggcaaccucauggccaaaccaugauaccaccagagguaccacaguugcaugcucccacucuggagccaacagcuuuuaucggaauuuacuauggauaguaaagaaaggaaacuccuauccuaagcucagcaagucauacacaaacaauaagggaaaggaagugcuuguaauuuggggagugcaccacccuccgaccgacaguguccaacaaacccucuaccagaauaaucauacauauguuucaguuggaucaucaaaauacuacaaaagguucacaccagaaauaguagcaagaccuaaagucagagaacaagcaggcagaaugaauuauuacuggacacuguuagaucaaggggacaccauaacuuuugaagccacugggaauuuaauagcaccauggcacgcauuugcauugaaaaaaggcucuaguucuggaauuaugaggucggaugcucagguucacaauugcacuacaaagugccaaacuccccauggggccuugaaaggcaaucuuccuuuucagaauguacaucccgucacuauuggagaaugccccaaauauguuaaaagcacccaacugagaauggcaacaggacuaaggaauauccccucuauucaauccagaggacuuuucggggcaauugccggauucauugaaggaggauggacaggaaugguagauggaugguauggauaucaccaucgaaaugagcagggaucugguuacgcagcagaucagaaaagcacacaaauugcaauugaugggauaaguaacaaagugaacucagugauugaaaaaaugaacauucaauuuacuucagugggcaaggaguucaauagucuagagaaaaggauggaaaauuugaauaagaagguugaugauggguuuuuggauguauggacauauaacgcugaguugcucauuuuacucgagaaugaaaggacucuagauuuccaugaccuuaacguaaaaaauuuauaugaaaaggucaaaucacaacuaaggaacaaugcuaaggaaaucggaaauggcugcuuugaguucuaucacaaaugugauaaugagugcauggaaagcguaaagaauggcacauacaauuaucucaaauauucagaagaauccaaguugaauagggaggaaauagauggugugaaacuagaaucaaugggaauucaccagauuuuggcgaucuacuccacagucgccaguucccuggucuuauuagucucccugggggcaaucagcuucuggauguguucuaaugggucauugcaaugcagaguaugcauuuaa

SEQ ID NO: 38645 - RNA, 1698 nt, Artificial Sequence; identical to SEQ ID NO: 33782
  hemagglutinin__InfluenzaA__AEX92873

SEQ ID NO: 38646 - RNA, 1701 nt, Artificial Sequence
  hemagglutinin__InfluenzaA__AEY69088
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38647 - RNA, 1701 nt, Artificial Sequence; identical to SEQ ID NO: 33934
  hemagglutinin__InfluenzaA__AEY69098

SEQ ID NO: 38648 - RNA, 1701 nt, Artificial Sequence
  hemagglutinin__InfluenzaA__AEY69120
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccucgauggagaaaacugcacgcuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggggacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacucaagcagcaauugaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagacuggauccuauggauuuccuuugccauaucauguuuuuugcuuuguguugcuuuguugggguucaucaugugggccugccaaaaaggcaacauuaggugcaacauuugcauuuga

SEQ ID NO: 38649 - RNA, 1701 nt, Artificial Sequence
  hemagglutinin__InfluenzaA__AEY69131
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38650 - RNA, 1701 nt, Artificial Sequence
  hemagglutinin__InfluenzaA__AEY69153
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuacaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38651 - RNA, 1701 nt, Artificial Sequence
  hemagglutinin__InfluenzaA__AEY69164
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggaacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38652 - RNA, 1701 nt, Artificial Sequence; identical to SEQ ID NO: 38651
  hemagglutinin__InfluenzaA__AEY69175

SEQ ID NO: 38653 - RNA, 1701 nt, Artificial Sequence; identical to SEQ ID NO: 38651
  hemagglutinin__InfluenzaA__AEY69186

SEQ ID NO: 38654 - RNA, 1701 nt, Artificial Sequence
  hemagglutinin__InfluenzaA__AEY69197
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuaccgagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacugucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaagugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38655 - RNA, 1701 nt, Artificial Sequence; identical to SEQ ID NO: 38654
  hemagglutinin__InfluenzaA__AEY69208

SEQ ID NO: 38656 - RNA, 1701 nt, Artificial Sequence
  hemagglutinin__InfluenzaA__AEY69219
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38657 - RNA, 1701 nt, Artificial Sequence
  hemagglutinin__InfluenzaA__AEY69258
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggggacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaauugaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38658 - RNA, 1701 nt, Artificial Sequence; identical to SEQ ID NO: 38656
  hemagglutinin__InfluenzaA__AEY69269

SEQ ID NO: 38659 - RNA, 1701 nt, Artificial Sequence; identical to SEQ ID NO: 38648
  hemagglutinin__InfluenzaA__AEY69291

SEQ ID NO: 38660 - RNA, 1701 nt, Artificial Sequence; identical to SEQ ID NO: 38648
  hemagglutinin__InfluenzaA__AEY69302

SEQ ID NO: 38661 - RNA, 1701 nt, Artificial Sequence; identical to SEQ ID NO: 38648
  hemagglutinin__InfluenzaA__AEY69313

SEQ ID NO: 38662 - RNA, 1701 nt, Artificial Sequence; identical to SEQ ID NO: 38648
  hemagglutinin__InfluenzaA__AEY69785

SEQ ID NO: 38663 - RNA, 1701 nt, Artificial Sequence
  hemagglutinin__InfluenzaA__AEY69807
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuacaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaauuacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38664 - RNA, 1701 nt, Artificial Sequence
  hemagglutinin__InfluenzaA__AEY69818
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggaaaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacaucugcauuuga

SEQ ID NO: 38665 - RNA, 1701 nt, Artificial Sequence
  hemagglutinin__InfluenzaA__AEY69829
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcaggauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38666 - RNA, 1701 nt, Artificial Sequence
  hemagglutinin__InfluenzaA__AEY69840
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38667 - RNA, 1701 nt, Artificial Sequence
  hemagglutinin__InfluenzaA__AEY69851
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugaugggaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccgggcacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaaggggguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38668 - RNA, 1701 nt, Artificial Sequence
  hemagglutinin__InfluenzaA__AEY69873
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38669 - RNA, 1701 nt, Artificial Sequence
  hemagglutinin__InfluenzaA__AEY69884
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugccugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38670 - RNA, 1701 nt, Artificial Sequence; identical to SEQ ID NO: 38668
  hemagglutinin__InfluenzaA__AEY69895

SEQ ID NO: 38671 - RNA, 1701 nt, Artificial Sequence; identical to SEQ ID NO: 38650
  hemagglutinin__InfluenzaA__AEY69906

SEQ ID NO: 38672 - RNA, 1701 nt, Artificial Sequence
  hemagglutinin__InfluenzaA__AEY69917
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaauugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggaacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38673 - RNA, 1701 nt, Artificial Sequence
  hemagglutinin__InfluenzaA__AEY69939
augaagacuaucauugcuuugagcuacauucuaugucugguuuucgcucaaaaaauuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuggaugcaucacuccaaauggaagcauucccaaugacaaaccauuccaaaauguaaacaggaucacauacggggucugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauugguuccuauggauuuccuuugccauaucauguuuuuugcuuuguguugcuuuguugggguucaucaugugggccugccaaaaaggcaacauuaggugcaacauuugcauuuga

SEQ ID NO: 38674 - RNA, 1701 nt, Artificial Sequence; identical to SEQ ID NO: 38673
  hemagglutinin__InfluenzaA__AEY69950

SEQ ID NO: 38675 - RNA, 1701 nt, Artificial Sequence; identical to SEQ ID NO: 38673
  hemagglutinin__InfluenzaA__AEY69961

SEQ ID NO: 38676 - RNA, 1701 nt, Artificial Sequence
  hemagglutinin__InfluenzaA__AEY69994
augaagacuaucauugcuuugagcuacauucuaugucugguuuucgcucaaaaaauuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuggaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauugguuccuauggauuuccuuugccauaucauguuuuuugcuuuguguugcuuuguugggguucaucaugugggccugccaaaaaggcaacauuaggugcaacauuugcauuuga

SEQ ID NO: 38677 - RNA, 1701 nt, Artificial Sequence; identical to SEQ ID NO: 38676
  hemagglutinin__InfluenzaA__AEY70005

SEQ ID NO: 38678 - RNA, 1701 nt, Artificial Sequence; identical to SEQ ID NO: 38651
  hemagglutinin__InfluenzaA__AEY70016

SEQ ID NO: 38679 - RNA, 1701 nt, Artificial Sequence
  hemagglutinin__InfluenzaA__AEY70256
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacggcaacuguuacccuuaugaugugccggauuaugccucccuuaggucacuaguugccucauccggaacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacaugcuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38680 - RNA, 1701 nt, Artificial Sequence
  hemagglutinin__InfluenzaA__AEY70267
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcaggauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaauuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38681 - RNA, 1701 nt, Artificial Sequence; identical to SEQ ID NO: 38680
  hemagglutinin__InfluenzaA__AEY70278

SEQ ID NO: 38682 - RNA, 1701 nt, Artificial Sequence; identical to SEQ ID NO: 34103
  hemagglutinin__InfluenzaA__AEY70289

SEQ ID NO: 38683 - RNA, 1701 nt, Artificial Sequence
  hemagglutinin__InfluenzaA__AEY70300
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggcuugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38684 - RNA, 1701 nt, Artificial Sequence; identical to SEQ ID NO: 38683
  hemagglutinin__InfluenzaA__AEY70311

SEQ ID NO: 38685 - RNA, 1701 nt, Artificial Sequence; identical to SEQ ID NO: 38665
  hemagglutinin__InfluenzaA__AEY70333

SEQ ID NO: 38686 - RNA, 1701 nt, Artificial Sequence; identical to SEQ ID NO: 38676
  hemagglutinin__InfluenzaA__AEY70344

SEQ ID NO: 38687 - RNA, 1701 nt, Artificial Sequence; identical to SEQ ID NO: 37610
  hemagglutinin__InfluenzaA__AEY70355

SEQ ID NO: 38688 - RNA, 1701 nt, Artificial Sequence
  hemagglutinin__InfluenzaA__AEY70365
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacgcuaauagaugcucuauugggagacccucagugugauggauuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggggacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacucaagcagcaauugaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38689 - RNA, 1701 nt, Artificial Sequence; identical to SEQ ID NO: 38666
  hemagglutinin__InfluenzaA__AEY70376

SEQ ID NO: 38690 - RNA, 1701 nt, Artificial Sequence
  hemagglutinin__InfluenzaA__AFB18656
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 38691 - RNA, 1701 nt, Artificial Sequence; identical to SEQ ID NO: 37554
  hemagglutinin__InfluenzaA__AFB40597

SEQ ID NO: 38692 - RNA, 1701 nt, Artificial Sequence; identical to SEQ ID NO: 37554
  hemagglutinin__InfluenzaA__AFB40598

SEQ ID NO: 38693 - RNA, 1701 nt, Artificial Sequence
  hemagglutinin__InfluenzaA__AFB40599
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacuugaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38694 - RNA, 1701 nt, Artificial Sequence
  hemagglutinin__InfluenzaA__AFB40600
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacggaaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38695 - RNA, 1701 nt, Artificial Sequence
  hemagglutinin__InfluenzaA__AFB40601
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccgagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcgauaaacaccagccuaccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38696 - RNA, 1701 nt, Artificial Sequence; identical to SEQ ID NO: 33803
  hemagglutinin__InfluenzaA__AFB40602

SEQ ID NO: 38697 - RNA, 1701 nt, Artificial Sequence
  hemagglutinin__InfluenzaA__AFB40603
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagacacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaagaaauagauggggugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38698 - RNA, 1701 nt, Artificial Sequence
  hemagglutinin__InfluenzaA__AFB40604
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaagaaggaaauucauacccaaagcucagcaaauccuacauuaaugauaaagggaaagaaguccucgugcuauggggcauucaccauccaccuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggcaacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagauaaagaguucaaccaccuggaaaaaagaauagggaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 38699 - RNA, 1701 nt, Artificial Sequence; identical to SEQ ID NO: 33173
  hemagglutinin__InfluenzaA__AFB70138

SEQ ID NO: 38700 - RNA, 1701 nt, Artificial Sequence
  hemagglutinin__InfluenzaA__AFB70145
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguauaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38701 - RNA, 1701 nt, Artificial Sequence
  hemagglutinin__InfluenzaA__AFB70154
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgagaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38702 - RNA, 1701 nt, Artificial Sequence; identical to SEQ ID NO: 33173
  hemagglutinin__InfluenzaA__AFB70156

SEQ ID NO: 38703 - RNA, 1701 nt, Artificial Sequence
  hemagglutinin__InfluenzaA__AFB70158
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaccaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38704 - RNA, 1701 nt, Artificial Sequence
  hemagglutinin__InfluenzaA__AFB70160
augaaggcaauacuaguaguucugcuguauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguauaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38705 - RNA, 1701 nt, Artificial Sequence; identical to SEQ ID NO: 35648
  hemagglutinin__InfluenzaA__AFB70162

SEQ ID NO: 38706 - RNA, 1701 nt, Artificial Sequence
  hemagglutinin__InfluenzaA__AFB70167
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaaugagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38707 - RNA, 1701 nt, Artificial Sequence; identical to SEQ ID NO: 36786
  hemagglutinin__InfluenzaA__AFB70177

SEQ ID NO: 38708 - RNA, 1701 nt, Artificial Sequence; identical to SEQ ID NO: 33742
  hemagglutinin__InfluenzaA__AFB70187

SEQ ID NO: 38709 - RNA, 1701 nt, Artificial Sequence; identical to SEQ ID NO: 35648
  hemagglutinin__InfluenzaA__AFB70197

SEQ ID NO: 38710 - RNA, 1701 nt, Artificial Sequence; identical to SEQ ID NO: 33804
  hemagglutinin__InfluenzaA__AFB70207

SEQ ID NO: 38711 - RNA, 1701 nt, Artificial Sequence; identical to SEQ ID NO: 33173
  hemagglutinin__InfluenzaA__AFB70217

SEQ ID NO: 38712 - RNA, 1701 nt, Artificial Sequence; identical to SEQ ID NO: 33173
  hemagglutinin__InfluenzaA__AFB70227

SEQ ID NO: 38713 - RNA, 1701 nt, Artificial Sequence
  hemagglutinin__InfluenzaA__AFB70247
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaaggaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38714 - RNA, 1701 nt, Artificial Sequence
  hemagglutinin__InfluenzaA__AFB70257
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucgucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38715 - RNA, 1701 nt, Artificial Sequence
  hemagglutinin__InfluenzaA__AFB70267
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauuacauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacaugugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38716 - RNA, 1701 nt, Artificial Sequence
  hemagglutinin__InfluenzaA__AFB70277
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuaucacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38717 - RNA, 1701 nt, Artificial Sequence; identical to SEQ ID NO: 33173
  hemagglutinin__InfluenzaA__AFB70287

SEQ ID NO: 38718 - RNA, 1701 nt, Artificial Sequence; identical to SEQ ID NO: 33173
  hemagglutinin__InfluenzaA__AFB70297

SEQ ID NO: 38719 - RNA, 1701 nt, Artificial Sequence; identical to SEQ ID NO: 33173
  hemagglutinin__InfluenzaA__AFB70307

SEQ ID NO: 38720 - RNA, 1701 nt, Artificial Sequence; identical to SEQ ID NO: 38700
  hemagglutinin__InfluenzaA__AFB70317

SEQ ID NO: 38721 - RNA, 1701 nt, Artificial Sequence
  hemagglutinin__InfluenzaA__AFB70327
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccugggaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38722 - RNA, 1701 nt, Artificial Sequence; identical to SEQ ID NO: 33173
  hemagglutinin__InfluenzaA__AFB70337

SEQ ID NO: 38723 - RNA, 1701 nt, Artificial Sequence
  hemagglutinin__InfluenzaA__AFB70347
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38724 - RNA, 1701 nt, Artificial Sequence; identical to SEQ ID NO: 33173
  hemagglutinin__InfluenzaA__AFB70367

SEQ ID NO: 38725 - RNA, 1701 nt, Artificial Sequence; identical to SEQ ID NO: 33173
  hemagglutinin__InfluenzaA__AFB70377

SEQ ID NO: 38726 - RNA, 1701 nt, Artificial Sequence
  hemagglutinin__InfluenzaA__AFB70387
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccuaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38727 - RNA, 1701 nt, Artificial Sequence; identical to SEQ ID NO: 33173
  hemagglutinin__InfluenzaA__AFB70397

SEQ ID NO: 38728 - RNA, 1701 nt, Artificial Sequence; identical to SEQ ID NO: 33173
  hemagglutinin__InfluenzaA__AFB70407

SEQ ID NO: 38729 - RNA, 1701 nt, Artificial Sequence
  hemagglutinin__InfluenzaA__AFB77618
augaaggcaauacuaguaguucugcuauauacauuugcaaccgcaaaugcagacacauuauguauagguuaucaugcgaacaauucaacagacacuguagacacaguacuagaaaagaauguaacaguaacacacuccguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaacuaccacuggugaccaacaaagucucuaucagaaugcagauggauauguuuuuguggggacaacaagauacagcaagaaguucaaaccggaaauaggaauaagacccaaggugaaggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgacugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguaaugguagucucccugggggcaaucagcuucuggaugugcucuaaugggucucuacaguguagaauauguauuuaa

SEQ ID NO: 38730 - RNA, 1701 nt, Artificial Sequence
  hemagglutinin__InfluenzaA__AFB77619
augaaggcaauacuaguaguucugcuauauacauuugcaaccgcaaaugcagacacauuguguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuguaugaaaagguaagaaaccaguuaaaaaacaaugcuaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38731 - RNA, 1701 nt, Artificial Sequence; identical to SEQ ID NO: 38730
  hemagglutinin__InfluenzaA__AFB77620

SEQ ID NO: 38732 - RNA, 1701 nt, Artificial Sequence
  hemagglutinin__InfluenzaA__AFB77621
augaaggcaauacuaguaguucugcuauauacauuugcaaccgcaaaugcagacacauuguguauagguuaucaugcgaacaauucaacagacacuguagacacaguacuagagaagaauguaacaguaacacacucuguuaaccuucuagaagacaagcauaacgggaaacuaugcaaacuaagagggguaaccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcagaccaacaaagucucuaucagaaugcagaugcauauguuuuuguggggacaucaagauacagcaagaaguucaagccggaaauagcaauaagacccaaagugagggaucaagaagggagaaugaacuauuacuggacauuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacgggauugaggaauaucccgucuauucaaucuagaggccuauuuggggccauugccggcuucauugaagggggguggacaggaaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugacgaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcuaaggaaauuggaaacggcugcuuugaauuuuaccacaaaugcgauaacacgugcauggaaagugucaaaaauggaacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38733 - RNA, 1701 nt, Artificial Sequence
  hemagglutinin__InfluenzaA__AFB77622
augaaggcaauacuaguaguucugcuauauacauuugcaaccgcaaaugcagacacauuguguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugaaauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaaggaaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuguaugaaaagguaagaaaccaguuaaaaaacaaugcuaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 38734 - RNA, 1701 nt, Artificial Sequence
  hemagglutinin__InfluenzaA__AFB77623
augaaggcaauacuaguaguucugcuauauacauuugcaaccgcaaaugcagacacauuguguauagguuaucaugcgaacaauucaacagacacuguagacacaguacuagagaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcagaccaacagagucucuaucagaaugcagaugcauauguuuuuguggggacaucaagauacagcaagaaguucaagccggaaauagcaauaagacccaaagugagggaucaagaagggagaaugaacuauuacuggacacuaguagagccuggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcuaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaagaauuuaccagauuuuggcgaucuauucaacugucgccaguucauugguacugguagucucccugggggcaaucaguuucuggaugugcucuaaugggucucuacaguguagaauauguauuuaa

SEQ ID NO: 38735 - RNA, 1701 nt, Artificial Sequence
  hemagglutinin__InfluenzaA__AFB77624
augaaggcaauacuaguaguucugcuauauacauuugcaaccgcaaaugcagacacauuguguauagguuaucaugcgaacaauucaacagacacuguagacacaguacuggagaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcagaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccuggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacauacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38736 - RNA, 1701 nt, Artificial Sequence
  hemagglutinin__InfluenzaA__AFB77625
augaaggcaauacuaguaguucugcuauauacauuuacaaccgcaaaugcagacacauuguguauagguuaucaugcgaacaauucaacagacacuguagacacaguacuagagaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcagaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccuggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcuaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaagaauuuaccagauuuuggcgaucuauucaacugucgccaguucauugguacugguagucucccugggggcaaucaguuucuggaugugcucuaaugggucucuacaguguagaauauguauuuaa

SEQ ID NO: 38737 - RNA, 1701 nt, Artificial Sequence
  hemagglutinin__InfluenzaA__AFB77627
augaaggcaauacuaguaguucugcuauauacauuugcaaccgcaaaugcagacacauuguguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauucuccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugacaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuauuauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcuaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38738 - RNA, 1701 nt, Artificial Sequence
  hemagglutinin__InfluenzaA__AFB77628
augaaggcaauacuaguaguucugcuauauacauuugcaaccgcaaaugcagacacauuguguauagguuaucaugcgaacaauucaacagacacuguagacacaguacuagagaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcagaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccuggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcuaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaagaauuuaccagauuuuggcgaucuauucaacugucgccaguucauugguacugguagucucccugggggcaaucaguuucuggaugugcucuaaugggucucuacaguguagaauauguauuuaa

SEQ ID NO: 38739 - RNA, 1701 nt, Artificial Sequence
  hemagglutinin__InfluenzaA__AFB77629
augaaggcaauacuaguaguucugcuauauacauuuacaaccgcaaaugcagacacauuguguauagguuaucaugcgaacaauucaacagacacuguagacacaguacuagagaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcagaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacgggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacauacaaugaagaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38740 - RNA, 1701 nt, Artificial Sequence
  hemagglutinin__InfluenzaA__AFB77630
augaaggcaauacuaguaguucugcuauauacauuugcaaccgcaaaugcagacacauuguguauagguuaucaugcgaacaauucaacagacacuguagacacaguacuagagaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugagucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcagaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcuaaggaaauuggaaacggcugcuuugaauuuuaucacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38741 - RNA, 1701 nt, Artificial Sequence
  hemagglutinin__InfluenzaA__AFB77631
augaaggcaauacuaguaguucugcuauauacauuuacaaccgcaaaugcagacacauuguguauagguuaucaugcgaacaauucaacagacacuguagacacaguacuagagaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcagaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacgggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaccaaugcuaaggaaauuggaaacggcugcuuugaauucuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38742 - RNA, 1701 nt, Artificial Sequence
  hemagglutinin__InfluenzaA__AFB77632
augaaggcaauacuaguaguucugcuauauacauuugcaaccgcaaaugcagacacauuguguauagguuaucaugcgaacaauucaacagacacuguagacacaguacuagagaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucaccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcagaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcuaaggaaauuggaaacggcugcuuugaauuuuaucacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguaaaauauguauuuaa

SEQ ID NO: 38743 - RNA, 1701 nt, Artificial Sequence
  hemagglutinin__InfluenzaA__AFB77633
augaaggcaauacuaguaguucugcuauauacauuugcaaccgcaaaugccgacacauuguguauagguuaccaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaaacucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaaggauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaaaaaaccaauuaaaaaacaaugcuaaggaaauuggaaacggcugcuuugaauuuuaccacaaaugcgauaacacgcccaucaaaaaugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38744 - RNA, 1701 nt, Artificial Sequence
  hemagglutinin__InfluenzaA__AFB77634
augaaggcaauacuaguaguucugcuauauacauuugcaaccgcaaaugcagacacauuguguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagaaaaaauaacauucgaagcaacuggaaaucuagugguaccgagauaugcauucgcaauggaaagaaaugcuggaucugguauuaucauuucagauacaccaguccacgauugcaauacaacuugucagacacccaagggggcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucaucgaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugagagaacuuuggacuaccacgauucaaaugugaaaaacuuguaugaaaagguaagaaaccaguuaaaaaacaaugcuaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38745 - RNA, 1701 nt, Artificial Sequence
  hemagglutinin__InfluenzaA__AFB77635
augaaggcaauacuaguaguuuugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcccaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38746 - RNA, 1701 nt, Artificial Sequence
  hemagglutinin__InfluenzaA__AFB77636
augaaggcaauacuaguaguucugcuauauacauuugcaaccgcaaaugcagacacauuguguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaggcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcuaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguaaugguagucucccugggggcaaucaguuucuggaugugcucuaaugggucucuacaguguagaauauguauuuaa

SEQ ID NO: 38747 - RNA, 1701 nt, Artificial Sequence
  hemagglutinin__InfluenzaA__AFB77637
augaaggcaauacuaguaguucugcuauauacauuugcaaccgcaaaugcagacacauuguguauagguuaucaugcgaacaauucaacagacacuguagacacaguacuagagaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcagaccaacaaagucucuaucagaaugcagaugcauauguuuuuguggggacaucaagauacagcaagaaguucaagccggaaauagcaauaagacccaaagggagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacgggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcuaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38748 - RNA, 1701 nt, Artificial Sequence
  hemagglutinin__InfluenzaA__AFB77638
augaaggcaauacuaguaguucugcuauauacauuugcaaccgcaaaugcagacacauuguguauagguuaucaugcgaacaauucaacagacacuguagacacaguacuagagaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauucuacauuaaugauaaagggaaagaaguccucgugcuguggggcauucaccauccaucuacuacugcagaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacgggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcuaaggaaauuggaaacggcugcuuugaauucuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38749 - RNA, 1701 nt, Artificial Sequence
  hemagglutinin__InfluenzaA__AFB77639
augaaggcaauacuaguaguucugcuauauacauuugcaaccgcaaaugcagacacauuguguauagguuaucaugcgaacaauucaacagacacuguagacacaguacuagagaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcagaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcuaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauuaguacugguagucucccugggggcaaucaguuucuggaugugcucuaaugggucucuacaguguagaauauguauuuaa

SEQ ID NO: 38750 - RNA, 1701 nt, Artificial Sequence
  hemagglutinin__InfluenzaA__AFB77640
augaaggcaauacuaguaguucugcuauauacauuugcaaccgcaaaugcagacacauuguguauagguuaucaugcgaacaauucaacagacacuguagacacaguacuagagaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcagaccaacaaggucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaccuagugguaccgagauaugcauucgcaauggaaagaaaugcuggaucuggcauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacgggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcuaaggaaauuggaaacggcugcuuugaauucuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38751 - RNA, 1701 nt, Artificial Sequence
  hemagglutinin__InfluenzaA__AFB77641
augaaggcaauacuaguaguucugcuauauacauuugcaaccgcaaaugcagacacauuguguauagguuaucaugcgaacaauucaacagacacuguagacacaguacuagaaaagaauguaacaguaacacacucuguuaaccuucuagaagacaagcauaacgggaaacuaugcaaacuaagagggguagccccauuacauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggggcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcuaaggaaauuggaaacggcugcuuugaauuuuaccacaaaugcgauaacaugugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacuguugccaguucauugguacugguagucucccugggggcaaucaguuucuggaugugcucuaaugggucucuacaguguagaauauguauuuaa

SEQ ID NO: 38752 - RNA, 1701 nt, Artificial Sequence
  hemagglutinin__InfluenzaA__AFB77642
augaaggcaauacuaguaguucugcuauauacauuugcaaccgcaaaugcagacacauuguguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggggcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaucaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugagagaacuuuggacuaccacgauucaaaugugaagaacuuguacgaaaagguaagaaaccaguuaaaaaacaaugcuaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38753 - RNA, 1701 nt, Artificial Sequence
  hemagglutinin__InfluenzaA__AFB77643
augaaggcaauacuaguaguucugcuauauacauuugcaaccgcaaaugcagacacauuguguauagguuaucaugcgaacaauucaacagacacuguagacacagugcuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagccaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggggcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugagagaacuuuggacuaccacgauucaaaugugaagaacuuguaugaaaagguaagaaaccaguuaaaaaacaaugcuaaggaaauuggaaacggcugcuuugaauuuuaccacaaaugcgauaacacgugcauggaaagugucaaaaauggaacuuaugacgacacaaaagacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38754 - RNA, 1701 nt, Artificial Sequence
  hemagglutinin__InfluenzaA__AFB77691
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugaaaaauuguacauuugggggguucaccacccggguacggacaaggaccaaaucuuccuguaugcucaagcaucaggaagaaucacaguaucuaccaaaagaagccaacaagcuguaaucccgaauaucggaucuagacucagaguaaggaauaucccuagcagaauaagcaucuauuggacaauaguaaaaccgggagacauacuuuugauuaacagcacagggaaucuaaacgcgccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggaggauucaggaccuugagaaauauguugaggacacuaaaauagaucucuggucauauaacgcagagcugcuuguugcccuggagaaccaacauacaauugaucuaacugacucagaaaugaacaaacuguuugaaaaaacaaagaaccaacugagggaaaaugcugaggauaugggcaaugguuguuucaaaauauaccacaaaugugacaauaccugcauaggaucaaucagaaauggaacuuaugaccacgaugcauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38755 - RNA, 1701 nt, Artificial Sequence
  hemagglutinin__InfluenzaA__AFB77692
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaccggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38756 - RNA, 1701 nt, Artificial Sequence
  hemagglutinin__InfluenzaA__AFB77693
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38757 - RNA, 1701 nt, Artificial Sequence
  hemagglutinin__InfluenzaA__AFB77694
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucgcgaaugaccaaauugaaguuacuaaugcuacugagcugguucagaauuccucaacaggugaaauaugcgacaguccucaucagauccuugauggagaaaacugcacacuaauagaugcucuauugggagacccucagugugaugacuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaaggaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaaacaacugagggaaaaugcugaggauaugggcaaugguuguuucaaaauauaccacaaaugugacaauaccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38758 - RNA, 1701 nt, Artificial Sequence
  hemagglutinin__InfluenzaA__AFB77695
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugaugacuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaaggaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38759 - RNA, 1701 nt, Artificial Sequence
  hemagglutinin__InfluenzaA__AFB78126
augaagacuaucauugcuuugagcuacauuuuaugucugguuuucgcucaaaaacuucccggaaaugacaacagcacggcaacgcugugccuggggcaccaugcagugucaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucaggauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagcauauaugcucaagcaucagggagagucacagucucuaccaaaagaagccaacaaacuguaaucccgaauaucggaucuagccccuggguaaggggugccuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaccaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 38760 - RNA, 1701 nt, Artificial Sequence
  hemagglutinin__InfluenzaA__AFC34056
augaagacuaucauugcuuugagcuacauucuaugucugguuuucgcucaaaaacuuccuggaaaugacaacagcacugcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagaacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccagcauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 38761 - RNA, 1701 nt, Artificial Sequence; identical to SEQ ID NO: 38760
  hemagglutinin__InfluenzaA__AFC34057

SEQ ID NO: 38762 - RNA, 1701 nt, Artificial Sequence
  hemagglutinin__InfluenzaA__AFD32426
augaaggcaaaccuacugguccuguuaagugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguaaacuaagagggguagccccauugcauuuggguaaauguaacauugcuggccggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauuguaacacgaagugucaaacaccccugggagcuauaaacagcagucucccuuaccagaauauacacccagucacaauaggagagugcccaaaauacgucaggagugccaaauugaggaugguuacaggacuaaggaacacuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 38763 - RNA, 1698 nt, Artificial Sequence
  hemagglutinin__InfluenzaA__AFD32427
augaaggcaaaccuacugguccuguuaagugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuaugugaucuagauggagugaagccucuaauuuugagagauuguagcguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaagccgaaugaugcaaucaacuucgagaguaauggaaauuucauugcuccagaauaugcauacaaaauugucaagaaaggggacucaacaauuaugaaaagugaauuggaauaugguaacuguaacacgaagugucaaacaccccugggagcuauaaacagcagucucccuuaccagaauauacacccagucacaauaggagagugcccaaaauacgucaggagugccaaauugaggaugguuacaggacuaaggaacacuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 38764 - RNA, 1722 nt, Artificial Sequence
  hemagglutinin__InfluenzaA__AFD32428
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgaucuagauggagugaagccucuaauuuugagagauuguagcguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaagccgaaugaugcaaucaacuucgagaguaauggaaauuucauugcuccagaauaugcauacaaaauugucaagaaaggggacucaacaauuaugaaaagugaauuggaauaugguaacugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38765 - RNA, 1704 nt, Artificial Sequence
  hemagglutinin__InfluenzaA__AFD32429
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcacucaagggaaaaggccaacagaucugggacaauguggacuucuaggaacccuaauaggaccuccccaaugcgaucaauuucuggaguuugacgcugauuugauaauugaacgaagagaaggaaccgaugugugcuaucccgggaaguucacaaaugaagaaucacugaggcagauccuucgagggucaggaggaauugauaaggagucaauggguuucaccuauaguggaauaagaaccaauggggcaacgagugccuguagaagaucagguucuucuuucuaugcggagaugaagugguuacugucgaauucagacaaugcggaauuuccccaaaugacuaagucguauagaaaucccaggaacaaaccagcucugauaauuuggggagugcaucacucuggaucggcuacugagcagaccaaacucuauggaaguggaaacaaguugauaacaguaggaagcucgaaauaccagcaaucauucacuccaaguccgggagcacggccacaggugaauggacaaucaggaaggauugauuuucacuggcuacuccuugaucccaaugacacagugaccuucacuuucaauggggcauucauagcuccugacagggcaaguuucuuuagaggagaaucgcuaggaguccagagugauguuccuuuggauucugguugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38766 - RNA, 1701 nt, Artificial Sequence; identical to SEQ ID NO: 32265
  hemagglutinin__InfluenzaA__AFD63527

SEQ ID NO: 38767 - RNA, 1701 nt, Artificial Sequence
  hemagglutinin__InfluenzaA__AFD63538
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucaauaguugccucauccggcacacuggaguuuaacaaugaaagcuucaacuggacuggagucacucagaauggaacaagcucugcuugcaaaaggaaaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuguaugcucaagcaucaggaagaaucacagucucuaccaaaagaagccaacaaacuguaaucccgaauaucggaucuagacccaggguaagggacgucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguaccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38768 - RNA, 1701 nt, Artificial Sequence
  hemagglutinin__InfluenzaA__AFD63549
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38769 - RNA, 1701 nt, Artificial Sequence
  hemagglutinin__InfluenzaA__AFD63571
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38770 - RNA, 1701 nt, Artificial Sequence
  hemagglutinin__InfluenzaA__AFD63615
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaacuggacuggagucacucagaauggaacaagcucugcuugcaaaaggaaaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggacgucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaggagagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38771 - RNA, 1701 nt, Artificial Sequence
  hemagglutinin__InfluenzaA__AFD63626
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38772 - RNA, 1701 nt, Artificial Sequence
  hemagglutinin__InfluenzaA__AFD63637
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucuacuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggagccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaagagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38773 - RNA, 1701 nt, Artificial Sequence
  hemagglutinin__InfluenzaA__AFD63648
augaagacuaucauugcuuugagcuacauucuaugucugguuuucgcucaaaaacuucccggaaaugacaacagcauggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38774 - RNA, 1701 nt, Artificial Sequence
  hemagglutinin__InfluenzaA__AFD63659
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaaguaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38775 - RNA, 1701 nt, Artificial Sequence
  hemagglutinin__InfluenzaA__AFD63681
augaagacuaucauugcuuugagcuacauucuaugucugguuuucgcucaaaaacuucccggaaaugacaacagcacggcaacacugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccccagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaacuggacuggagucacucagaauggaacaagcucugcuugcaaaaggaaaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggacgucuccagcagaauaagcaucuauuggacaauaguaaaaccgggagacauacuuuugauuaacagcacagggaaucuaauugcuccucgggguuacuucaaaguacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38776 - RNA, 1701 nt, Artificial Sequence
  hemagglutinin__InfluenzaA__AFD63692
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggggacccucagugugauggcuuccaaaauaagaaaugggaccuuuuuguugaacgcagcaaagccuacagcaacuguuacccuuaugaugucccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucuccacccggguacggacagugaccaaaucagccuauaugcucaagcaucaggaagaaucacagucucuaccaaaagaagccaacaaacuguaauaccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacagacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaaaucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38777 - RNA, 1701 nt, Artificial Sequence
  hemagglutinin__InfluenzaA__AFD63703
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaaguggaauaugcgacaguccuuaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacagacagugaccaaaucagccuauaugcucaagcaucaggaagaaucacagucucuaccaaaagaagccaacaaacuguaaucccgaauaucggaucuagacccaggguaagggaugucuccagccaaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuucagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38778 - RNA, 1701 nt, Artificial Sequence
  hemagglutinin__InfluenzaA__AFD63714
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucuacuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacaaacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccauaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38779 - RNA, 1701 nt, Artificial Sequence
  hemagglutinin__InfluenzaA__AFD63736
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucuacuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccauaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38780 - RNA, 1701 nt, Artificial Sequence
  hemagglutinin__InfluenzaA__AFD63747
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggggacccucagugugauggcuuccaaaauaagaaaugggaccuuuuuguugaacgcagcaaagccuacagcaacuguuacccuuaugaugucccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacagacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucggauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaaaucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38781 - RNA, 1701 nt, Artificial Sequence
  hemagglutinin__InfluenzaA__AFD63758
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaacuggacuggagucacucagaauggaacaagcucugcuugcaaaaggaaaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggacgucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38782 - RNA, 1701 nt, Artificial Sequence
  hemagglutinin__InfluenzaA__AFD63769
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccauaucaaaaguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38783 - RNA, 1701 nt, Artificial Sequence; identical to SEQ ID NO: 30580
  hemagglutinin__InfluenzaA__AFD63780

SEQ ID NO: 38784 - RNA, 1701 nt, Artificial Sequence; identical to SEQ ID NO: 38781
  hemagglutinin__InfluenzaA__AFD63791

SEQ ID NO: 38785 - RNA, 1701 nt, Artificial Sequence
  hemagglutinin__InfluenzaA__AFD63802
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacugguggaauaugcgacaguccucaucagauccuugauggagaaaacugcacacuaauagaugcucuauugggagacccucagugugauggcuuccaaaauaagaaaugggaccuuuuuguugaacgcaguaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuucaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggauucaucaugugggccugccaaaaaggcaacauuaggugcaacauuugcauuuga

SEQ ID NO: 38786 - RNA, 1701 nt, Artificial Sequence
  hemagglutinin__InfluenzaA__AFD63813
augaagacuaucauugcuuugagcuacauucuaagucugguuuucgcucaaaaauuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcucacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguauagagaugaagcauuaaacaaccgguuccagaucaaagguguugagcugaagucaggauacaaagauuggauccuauggauuuccuuugccacaucauguuuuuugcuuuguguugcuuuguugggguucaucaugugggccugccaaaaaggcaacauuaggugcaacauuugcauuuga

SEQ ID NO: 38787 - RNA, 1701 nt, Artificial Sequence
  hemagglutinin__InfluenzaA__AFD63824
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucuccagccgaauaagcaucuauuggacaauaguaaaaccgggagacauacuuuugauuaacagcacagggaaucuaauugcuccucggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccagaaaggcaacauuaggugcaacauuugcauuuga

SEQ ID NO: 38788 - RNA, 1701 nt, Artificial Sequence
  hemagglutinin__InfluenzaA__AFD63846
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggauuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38789 - RNA, 1701 nt, Artificial Sequence
  hemagglutinin__InfluenzaA__AFD63857
augaagacuaucauugcuuugagcuacauuuuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggggaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagaccaaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaggcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggaucuuauggauuuccuuugccauaucauguuuuuugcuuuguguugcuuuguugggguucaucaugugggccugccaaaaaggcaacauuaggugcaacauuugcauuuga

SEQ ID NO: 38790 - RNA, 1701 nt, Artificial Sequence
  hemagglutinin__InfluenzaA__AFD63868
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaggcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugaucaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugagaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38791 - RNA, 1701 nt, Artificial Sequence; identical to SEQ ID NO: 30580
  hemagglutinin__InfluenzaA__AFD63890

SEQ ID NO: 38792 - RNA, 1701 nt, Artificial Sequence
  hemagglutinin__InfluenzaA__AFD63901
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccagaguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38793 - RNA, 1701 nt, Artificial Sequence
  hemagglutinin__InfluenzaA__AFD63912
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagguaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38794 - RNA, 1701 nt, Artificial Sequence
  hemagglutinin__InfluenzaA__AFD63923
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaacuggacuggagucacucagaauggaacaagcucugcuugcaaaaggaaaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggacaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38795 - RNA, 1701 nt, Artificial Sequence
  hemagglutinin__InfluenzaA__AFD63934
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugaacugguucagaguuccucaacagguggaauaugcgacaguccucaucagauccuugauggagaaaacugcacacuaauagaugcucuauugggagacccucaaugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauuaaacgugacuaugccaaacaaugaaaaauuugacaaauuguacauuugggggguucaccacccggguacggaaagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaguaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcagguuucauagaaaaugguugggagggaaugguggacgguugguacgguuucaggcaucaaaacucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaucaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38796 - RNA, 1701 nt, Artificial Sequence
  hemagglutinin__InfluenzaA__AFD63945
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucuccagccgaauaagcaucuauuggacaauaguaaaaccgggagacauacuuuugauuaacagcacagggaaucuaauugcuccucggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucuaaaaagcacucaagcagcaaucaaccaaaucaaugggaaacugaauagguugaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccagaaaggcaacauuaggugcaacauuugcauuuga

SEQ ID NO: 38797 - RNA, 1701 nt, Artificial Sequence
  hemagglutinin__InfluenzaA__AFD63956
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38798 - RNA, 1701 nt, Artificial Sequence; identical to SEQ ID NO: 38787
  hemagglutinin__InfluenzaA__AFD63967

SEQ ID NO: 38799 - RNA, 1701 nt, Artificial Sequence
  hemagglutinin__InfluenzaA__AFD63989
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacaggaaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacuaaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38800 - RNA, 1701 nt, Artificial Sequence
  hemagglutinin__InfluenzaA__AFD64000
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuucagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38801 - RNA, 1701 nt, Artificial Sequence
  hemagglutinin__InfluenzaA__AFD64011
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaccaggaaaaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 38802 - RNA, 1701 nt, Artificial Sequence
  hemagglutinin__InfluenzaA__AFD64022
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucuaaaaagcacucaagcagcaaucaaccaaaucaaugggaaacugaauagguugaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccagaaaggcaacauuaggugcaacauuugcauuuga

SEQ ID NO: 38803 - RNA, 1701 nt, Artificial Sequence; identical to SEQ ID NO: 32265
  hemagglutinin__InfluenzaA__AFD64033

SEQ ID NO: 38804 - RNA, 1701 nt, Artificial Sequence
  hemagglutinin__InfluenzaA__AFD64044
augaagacuaucauugcuuugagcuacauucuaugucugguuuucgcucaaaaacuucccggaaaugaaaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggggacccucagugugauggcuuccaaaauaagaaaugggaccuuuuuguugaacgcagcaaagccuacagcaacuguuacccuuaugaugucccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaguacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacagacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaaaucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38805 - RNA, 1701 nt, Artificial Sequence; identical to SEQ ID NO: 38781
  hemagglutinin__InfluenzaA__AFD64055

SEQ ID NO: 38806 - RNA, 1701 nt, Artificial Sequence
  hemagglutinin__InfluenzaA__AFD64066
augaagacuaucauugcuuugagcuacauucuaugucugguuuucgcucaaaaacuucccggaaaugacaacagcacggcaacacugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuauaccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaaugcugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaaaauuggauccuauggauuuccuuugccauaucauguuuuuugcuuuguguugcuuuguugggguucaucaugugggccugccaaaaaggcaacauuaggugcaacauuugcauuuga

SEQ ID NO: 38807 - RNA, 1701 nt, Artificial Sequence
  hemagglutinin__InfluenzaA__AFD64077
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggauaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38808 - RNA, 1701 nt, Artificial Sequence
  hemagglutinin__InfluenzaA__AFD64088
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaucgguuccagaucaaagguguugagcugaagucaggauacaaagauuggauccuauggauuuccuuugccauaucauguuuuuugcuuuguguugcuuuguugggguucaucaugugggccugccagaaaggcaacauuaggugcaacauuugcauuuga

SEQ ID NO: 38809 - RNA, 1701 nt, Artificial Sequence; identical to SEQ ID NO: 30580
  hemagglutinin__InfluenzaA__AFD64099

SEQ ID NO: 38810 - RNA, 1701 nt, Artificial Sequence; identical to SEQ ID NO: 38781
  hemagglutinin__InfluenzaA__AFD64110

SEQ ID NO: 38811 - RNA, 1701 nt, Artificial Sequence
  hemagglutinin__InfluenzaA__AFD64121
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcagagccuacagcaacuguuacccuuaugaugugccggauuaugccucccuuaggucacuaguugccucauccggcacacuggaguuuaacaaugaaagcuucaacuggacuggagucacucagaauggaacaagcucugcuugcaaaaggaaaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuguaugcucaagcaucaggaagaaucacagucucuaccaaaagaagccaacaaacuguaaucccgaauaucggaucuagacccaggguaagggacgucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaggggagaauucaggaccucgagaaauauguugaggacacuaaaauagaucucuggucauacaacgcagagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38812 - RNA, 1701 nt, Artificial Sequence
  hemagglutinin__InfluenzaA__AFD64132
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaaacaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38813 - RNA, 1701 nt, Artificial Sequence; identical to SEQ ID NO: 38787
  hemagglutinin__InfluenzaA__AFD64143

SEQ ID NO: 38814 - RNA, 1701 nt, Artificial Sequence
  hemagglutinin__InfluenzaA__AFD64154
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaacucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccagaaaggcaacauuaggugcaacauuugcauuuga

SEQ ID NO: 38815 - RNA, 1701 nt, Artificial Sequence
  hemagglutinin__InfluenzaA__AFD64179
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcaguaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuucaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccaaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38816 - RNA, 1701 nt, Artificial Sequence
  hemagglutinin__InfluenzaA__AFD64190
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccaaauaagcaucuauuggacaauaguaaaaccgggagacauacuuuugauuaacagcacagggaaucuaauugcuccucggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccagaaaggcaacauuaggugcaacauuugcauuuga

SEQ ID NO: 38817 - RNA, 1701 nt, Artificial Sequence; identical to SEQ ID NO: 38797
  hemagglutinin__InfluenzaA__AFD64201

SEQ ID NO: 38818 - RNA, 1701 nt, Artificial Sequence
  hemagglutinin__InfluenzaA__AFD64212
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaacuggacuggagucacucagaauggaacaagcucugcuugcaaaaggaaaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggacgucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagccgcagaucucaaaagcacucaagcagcaaucaaccaaaucaaugggaaacugaauagguuaaucgggaaaacaaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38819 - RNA, 1701 nt, Artificial Sequence
  hemagglutinin__InfluenzaA__AFD64223
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccauuuaaaauacaaauacccagcauugaacgugacuaugccaaacaaugaaaaauuugacaaauuguacauuugggggguucuccacccggguacggacagugaccaaaucagacuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauauuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaauauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38820 - RNA, 1701 nt, Artificial Sequence
  hemagglutinin__InfluenzaA__AFD64315
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucaaauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaaucaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccagaaaggcaacauuaggugcaacauuugcauuuga

SEQ ID NO: 38821 - RNA, 1701 nt, Artificial Sequence
  hemagglutinin__InfluenzaA__AFD64326
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcagagccuacagcaacuguuacccuuaugaugugccggauuaugccucccuuaggucacuaguugccucauccggcacacuggaguuuaacaaugaaagcuucaacuggacuggagucacucagaauggaacaagcucugcuugcaaaaggaaaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuguaugcucaagcaucaggaagaaucacagucucuaccaaaagaagccaacaaacuguaaucccgaauaucggaucuagacccaggguaagggacgucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38822 - RNA, 1701 nt, Artificial Sequence; identical to SEQ ID NO: 38781
  hemagglutinin__InfluenzaA__AFD64337

SEQ ID NO: 38823 - RNA, 1701 nt, Artificial Sequence; identical to SEQ ID NO: 30580
  hemagglutinin__InfluenzaA__AFD64348

SEQ ID NO: 38824 - RNA, 1701 nt, Artificial Sequence; identical to SEQ ID NO: 38781
  hemagglutinin__InfluenzaA__AFD64359

SEQ ID NO: 38825 - RNA, 1701 nt, Artificial Sequence
  hemagglutinin__InfluenzaA__AFD64370
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucauugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaacuggacuggagucacucagaauggaacaagcucugcuugcaaaaggaaaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggacaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38826 - RNA, 1701 nt, Artificial Sequence; identical to SEQ ID NO: 30580
  hemagglutinin__InfluenzaA__AFD64381

SEQ ID NO: 38827 - RNA, 1701 nt, Artificial Sequence
  hemagglutinin__InfluenzaA__AFD64392
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaacuggacuggagucacucagaauggaacaagcucugcuugcaaaaggaaaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggacgucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38828 - RNA, 1701 nt, Artificial Sequence; identical to SEQ ID NO: 38797
  hemagglutinin__InfluenzaA__AFD64403

SEQ ID NO: 38829 - RNA, 1701 nt, Artificial Sequence; identical to SEQ ID NO: 38787
  hemagglutinin__InfluenzaA__AFD64414

SEQ ID NO: 38830 - RNA, 1701 nt, Artificial Sequence
  hemagglutinin__InfluenzaA__AFD64425
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccgaauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccauaauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38831 - RNA, 1701 nt, Artificial Sequence; identical to SEQ ID NO: 38799
  hemagglutinin__InfluenzaA__AFD64436

SEQ ID NO: 38832 - RNA, 1701 nt, Artificial Sequence; identical to SEQ ID NO: 38808
  hemagglutinin__InfluenzaA__AFD64447

SEQ ID NO: 38833 - RNA, 1701 nt, Artificial Sequence
  hemagglutinin__InfluenzaA__AFD64458
augaagacuaucauugcuuugagcuacauucuaugucugguuuucgcucaaaaacuucccggaaaugacaacagcacggcaacgcugugccuugggcaccaugcaguacaaaacggaacgauagugaaaacaaucacgaaugaccaaauugaaguuacuaaugcuacugagcugguucaaaguuccucaacagguggaauaugcgacaguccucaucagauccuugauggagaaaacugcacacuaauagaugcucuauugggagacccccagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38834 - RNA, 1701 nt, Artificial Sequence
  hemagglutinin__InfluenzaA__AFD64795
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugagauaugcaacaguccucaucagauccuugauggagaaaacugcacacuaauagaugcucuauugggggacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaucuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38835 - RNA, 1701 nt, Artificial Sequence
  hemagglutinin__InfluenzaA__AFD64799
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaguuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaaacaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38836 - RNA, 1701 nt, Artificial Sequence
  hemagglutinin__InfluenzaA__AFD64802
augaagaccaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaccuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaaggaagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucagaguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38837 - RNA, 1701 nt, Artificial Sequence
  hemagglutinin__InfluenzaA__AFD64804
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugauggaugguugguacgguuucaggcaucaaaauucugaggggaggggacaggcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38838 - RNA, 1701 nt, Artificial Sequence
  hemagglutinin__InfluenzaA__AFD64806
augaagaccaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaccuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38839 - RNA, 1701 nt, Artificial Sequence
  hemagglutinin__InfluenzaA__AFD64807
augaagaccaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaccuuccuguaugcucaagcaucaggaagaaucacaguaucuaccaaaagaagccaacaagcuguaauuccgaauaucggaucuagacccagaguaagggauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcaccccuuggcaaaugccauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauauguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38840 - RNA, 1701 nt, Artificial Sequence
  hemagglutinin__InfluenzaA__AFD64810
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaaacaacugagggaaaaugcugaggauaugggcaaugguuguuucaaaauauaccacaaaugugacaaugccugcauaggaucaaucagaaauggaacuuaugaccccgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38841 - RNA, 1701 nt, Artificial Sequence
  hemagglutinin__InfluenzaA__AFD64812
augaagaccaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaccuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacccaagcagcaaccgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38842 - RNA, 1701 nt, Artificial Sequence
  hemagglutinin__InfluenzaA__AFD64814
augaagaccaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauauccagcauugaacgugacuaugccaaacaaugaacaauuugacaaauuguacauuugggggguucaccacccggguacggacaaggaccaaaccuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccccgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38843 - RNA, 1701 nt, Artificial Sequence
  hemagglutinin__InfluenzaA__AFD64816
augaagacuaucauugcuuugagcuacauucuaugucugguuuucgcucaaaaacuuccugaaaaugacaacagcacggcaacgcugugccuugggcaccaugcagugccaaacgggacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcaugaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaagacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38844 - RNA, 1701 nt, Artificial Sequence
  hemagglutinin__InfluenzaA__AFD64818
augaagaccaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaccuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcaccccuuggcaaaugcauuucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38845 - RNA, 1701 nt, Artificial Sequence
  hemagglutinin__InfluenzaA__AFD64819
augaagaccaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacgggagucacucaaaacggaacaagcucugcuugcauaaggagaucuaauaauaguuucuuuaguagauugaauugguugacccacuuaaacuucaaauaccccgcauugaacgugacuaugccaaacaaugaacaauuugacaaauuguacauuugggggguucaccacccggguacggacaaggaccaaaccuuccuguaugcucaagcaucaggaagaaucacaguaucuaccaaaagaagccaacaagcuguaauuccgaauaucggaucuagacccagaauaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcauuucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccccgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38846 - RNA, 1701 nt, Artificial Sequence
  hemagglutinin__InfluenzaA__AFD64820
augaagaccaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguccaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcagguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugccuuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38847 - RNA, 1701 nt, Artificial Sequence
  hemagglutinin__InfluenzaA__AFD64822
augaagacuaucauugcuuugagcuacauucuaugucugguuuucgcucaaaaacuuccuggaaaugacaacagcacggcaacgcugugccuugggcaccaugcagugccaaacgggacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcaugaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaagacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38848 - RNA, 1701 nt, Artificial Sequence
  hemagglutinin__InfluenzaA__AFD64823
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugagauaugcaacaguccucaucagauccuugauggagaaaacugcacacuaauagaugcucuauugggggacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcagaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaucuugagaaauauguugaggacacuaaaauagaucucuggucauacaaugcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38849 - RNA, 1701 nt, Artificial Sequence
  hemagglutinin__InfluenzaA__AFD64824
augaagaccaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaccuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacgauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccacaucauguuuuuugcuuuguguugcuuuguugggguucaucaugugggccugccaaaaaggcaacauuaggugcaacauuugcauuuga

SEQ ID NO: 38850 - RNA, 1701 nt, Artificial Sequence; identical to SEQ ID NO: 38838
  hemagglutinin__InfluenzaA__AFD64825

SEQ ID NO: 38851 - RNA, 1701 nt, Artificial Sequence; identical to SEQ ID NO: 38838
  hemagglutinin__InfluenzaA__AFD64827

SEQ ID NO: 38852 - RNA, 1701 nt, Artificial Sequence
  hemagglutinin__InfluenzaA__AFD64828
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauucccaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugauggaugguugguacgguuucaggcaucaaaauucugagggaaggggacaggcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccccgauguauacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38853 - RNA, 1701 nt, Artificial Sequence
  hemagglutinin__InfluenzaA__AFD64830
augaagacuaucauugcuuugagcuacauucuaugucugguuuucgcucaaaaacuuccuggaaaugacaacagcacggcaacgcugugccuugggcaccaugcagugccaaacgggacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcaugaggagauccaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaagacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38854 - RNA, 1701 nt, Artificial Sequence
  hemagglutinin__InfluenzaA__AFD98095
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaaacaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38855 - RNA, 1701 nt, Artificial Sequence
  hemagglutinin__InfluenzaA__AFD98106
augaagaccaucauugcuuugagcuacauucuaugucugguuuucgcucagaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuagaugcaacauuugcauuuga

SEQ ID NO: 38856 - RNA, 1701 nt, Artificial Sequence
  hemagglutinin__InfluenzaA__AFD98128
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaauuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggaaaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauauuccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaauuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38857 - RNA, 1701 nt, Artificial Sequence; identical to SEQ ID NO: 38854
  hemagglutinin__InfluenzaA__AFD98139

SEQ ID NO: 38858 - RNA, 1701 nt, Artificial Sequence
  hemagglutinin__InfluenzaA__AFD98161
augaagaccaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacgggacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38859 - RNA, 1701 nt, Artificial Sequence
  hemagglutinin__InfluenzaA__AFD98172
augaagaccaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaacaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggguccuauggauuuccuuugccauaucauguuuuuugcuuuguguugcuuuguugggguucaucaugugggccugccaaaaaggcaacauuaggugcaacauuugcauuuga

SEQ ID NO: 38860 - RNA, 1701 nt, Artificial Sequence
  hemagglutinin__InfluenzaA__AFD98183
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuauacauuugggggguucaccacccggguacggacaaggaccaaaucuuccuguaugcucaagcaucaggaagaaucacaguaucuaccaaaagaagccaacaagcuguacuuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuacaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaccaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38861 - RNA, 1701 nt, Artificial Sequence
  hemagglutinin__InfluenzaA__AFD98194
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38862 - RNA, 1701 nt, Artificial Sequence
  hemagglutinin__InfluenzaA__AFD98205
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaaacucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccuuccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38863 - RNA, 1701 nt, Artificial Sequence
  hemagglutinin__InfluenzaA__AFD98215
augaagaccaucauugcuuugagcuacauucuaugucugguuuucgcucaaaaacuuccuggaaaugacaacagcacggcaacacugugccuugggcaccaugcaguaccaaacggaacgauagugaagacaaucacgaaugaccaaauugaaguuacuaaugcuacugagcugguucagaguuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38864 - RNA, 1701 nt, Artificial Sequence
  hemagglutinin__InfluenzaA__AFD98226
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugaccaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaucgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38865 - RNA, 1701 nt, Artificial Sequence
  hemagglutinin__InfluenzaA__AFD98237
augaagacuaucauugcuuugagcuacauucuaugucugguuucugcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38866 - RNA, 1701 nt, Artificial Sequence
  hemagglutinin__InfluenzaA__AFD98248
augaagaccaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagagguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38867 - RNA, 1701 nt, Artificial Sequence
  hemagglutinin__InfluenzaA__AFD98259
augaagaccaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucauauccuugauggagaaaacugcacacuaauagaugcucuauugggagacccucagugugauggcuuccaaaauaagaaaugggaccuuuuuguugaacgaagcaaagccuacagcaacuguuacccuuaugaugugcaggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38868 - RNA, 1701 nt, Artificial Sequence
  hemagglutinin__InfluenzaA__AFD98270
augaaggcaauacuaguaguucugcuauauacauuuguaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguaaccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaauacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38869 - RNA, 1701 nt, Artificial Sequence
  hemagglutinin__InfluenzaA__AFD98280
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugauucacucuccacagcaagaucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaagggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaauguuaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 38870 - RNA, 1701 nt, Artificial Sequence
  hemagglutinin__InfluenzaA__AFD98290
augaagacuaucauugcuuugagcuacauucuaugucugguuuucgcucaaaaacuuccuggaaaugacaacagcacggcaacgcugugccuugggcaccaugcagugccaaacgggacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcaugaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaggcagcagaucuuaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaagacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38871 - RNA, 1701 nt, Artificial Sequence
  hemagglutinin__InfluenzaA__AFD98310
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguagcauugcuggcuggauccugggaaauccagaaugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 38872 - RNA, 1701 nt, Artificial Sequence
  hemagglutinin__InfluenzaA__AFD98320
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuccuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacugcagcauguccucaugcuggagcaaaaggcuucuacaaaaauuuaauauggcuaguuaaaaaaggaaauucauacccaaagcucagcaaauccuacauuaaugauaaagggaaagaaguccuugugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucuggcauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccacuuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 38873 - RNA, 1701 nt, Artificial Sequence; identical to SEQ ID NO: 38858
  hemagglutinin__InfluenzaA__AFD98340

SEQ ID NO: 38874 - RNA, 1701 nt, Artificial Sequence
  hemagglutinin__InfluenzaA__AFD98351
augaagaccaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaacaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38875 - RNA, 1701 nt, Artificial Sequence
  hemagglutinin__InfluenzaA__AFD98362
augaagacuaucauugcuuugagcuacauucuaugucugguuuucgcucaaaaacuuccuggaaaugacaacagcauggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaggccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauuggucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagagaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcucuguguugcuuuguugggguucaucaugugggccugccaaaaaggcaacauuaggugcaacauuugcauuuga

SEQ ID NO: 38876 - RNA, 1701 nt, Artificial Sequence
  hemagglutinin__InfluenzaA__AFD98373
augaagaccaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38877 - RNA, 1701 nt, Artificial Sequence
  hemagglutinin__InfluenzaA__AFD98384
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaauaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugaguugaagucaggguacaaagauuggauccuauggauuuccuuugccauaucauguuuucugcuuuguguugcuuuguugggguucaucaugugggccugccaaaaaggcaacauuaggugcaacauuugcauuuga

SEQ ID NO: 38878 - RNA, 1701 nt, Artificial Sequence
  hemagglutinin__InfluenzaA__AFD98395
augaagaccaucauugcuuugagcuacauucuaugucugguuuucgcucaaaaacuuccuggagaugacaacagcacggcaacgcugugccuugggcaccaugcaguaccaaacggaacgauagugaaaacaaucacgaaugaccaaauugaaguuacuaaugcuacugagcugguucagaauuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggagccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38879 - RNA, 1701 nt, Artificial Sequence
  hemagglutinin__InfluenzaA__AFD98406
augaagaccaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38880 - RNA, 1701 nt, Artificial Sequence; identical to SEQ ID NO: 38858
  hemagglutinin__InfluenzaA__AFD98417

SEQ ID NO: 38881 - RNA, 1701 nt, Artificial Sequence
  hemagglutinin__InfluenzaA__AFD98428
augaagaccaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaccuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugccccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuuaccauaucauguuuuuugcuuuguguugcuuuguugggguucaucaugugggccugccaaaaaggcaacauuaggugcaacauuugcauuuga

SEQ ID NO: 38882 - RNA, 1701 nt, Artificial Sequence
  hemagglutinin__InfluenzaA__AFD98439
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauucugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38883 - RNA, 1701 nt, Artificial Sequence
  hemagglutinin__InfluenzaA__AFD98449
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugaugggaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaaacuucaauuggacuggagucacucaaaacggaacaagcucugcuugcauaaggagaucuaaaaacaguuucuuuaguagauugaauugguugacccacuuaaacuucaaauucccagcauugaacgugacuaugccaaacaaugaacaauuugacaaauuguacauuugggggguucaccacccggguacggacaaagaccaaaucuuccuauaugcucaagcaucaggaagaaucacagucucuaccaaaagaagccaacaaacugcaaucccgaauaucggaucuagacccagaguaaggaauaucccuagcagaauaagcauauauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaauggaugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucaaauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagggucaaucagaaauggaacuuauaaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38884 - RNA, 1701 nt, Artificial Sequence
  hemagglutinin__InfluenzaA__AFD98460
augaagaccaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguaaauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaacggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaagcaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38885 - RNA, 1701 nt, Artificial Sequence
  hemagglutinin__InfluenzaA__AFD98471
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaagcucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacauuaguagagccgggagacaaaauaacauucgaagcaacuggaaaucuagugguaccgagguaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaucaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38886 - RNA, 1701 nt, Artificial Sequence
  hemagglutinin__InfluenzaA__AFD98481
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaauuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaguaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaauuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38887 - RNA, 1701 nt, Artificial Sequence; identical to SEQ ID NO: 38854
  hemagglutinin__InfluenzaA__AFD98492

SEQ ID NO: 38888 - RNA, 1701 nt, Artificial Sequence
  hemagglutinin__InfluenzaA__AFD98503
augaagaccaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucugcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuaaaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38889 - RNA, 1701 nt, Artificial Sequence
  hemagglutinin__InfluenzaA__AFD98514
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccgggaacagacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaaguugaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaaacaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38890 - RNA, 1701 nt, Artificial Sequence
  hemagglutinin__InfluenzaA__AFD98525
augaagaccaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccauccggguacggacaaggaccaaaccuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38891 - RNA, 1701 nt, Artificial Sequence
  hemagglutinin__InfluenzaA__AFD98558
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggagcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaauuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38892 - RNA, 1701 nt, Artificial Sequence
  hemagglutinin__InfluenzaA__AFD98569
augaagaccaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacggagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaccuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacgaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38893 - RNA, 1701 nt, Artificial Sequence; identical to SEQ ID NO: 37484
  hemagglutinin__InfluenzaA__AFD98580

SEQ ID NO: 38894 - RNA, 1701 nt, Artificial Sequence
  hemagglutinin__InfluenzaA__AFE02942
augaaggcaauacuaguaguucugcuauauacauuugcaaccgcaaaugcagacacauuauguauagguuaucaugcgaacaauucaacagacacuguagacacauuacuagaaaagaauguaacaguaacacacucuguuaaccuucuagaagacaagcauaacgggaagcuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguguggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggacagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaauucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38895 - RNA, 1701 nt, Artificial Sequence
  hemagglutinin__InfluenzaA__AFE18688
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacagcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38896 - RNA, 1701 nt, Artificial Sequence; identical to SEQ ID NO: 31154
  hemagglutinin__InfluenzaA__AFE47624

SEQ ID NO: 38897 - RNA, 1701 nt, Artificial Sequence; identical to SEQ ID NO: 31904
  hemagglutinin__InfluenzaA__AFE47635

SEQ ID NO: 38898 - RNA, 1701 nt, Artificial Sequence; identical to SEQ ID NO: 38854
  hemagglutinin__InfluenzaA__AFF18506

SEQ ID NO: 38899 - RNA, 1701 nt, Artificial Sequence
  hemagglutinin__InfluenzaA__AFF57124
augaaggcaauacuaguaguucugcuauauacauuugcaaccgccaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauuaagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagaaaauucauacccaaagcucagcaaauccuacauuaaugauaaagggaaagagguccucgugcuauggggcauucaccauccaucuacuaccgcugaccaacaacgucucuaucagaaugcagaugcauauguuuuuguggggacaucaagauacagcaagaaguucaagccggaaauagcaauaagacccaaagugagggaucaagaagggagaaugaacuauuacuggacacuaguagagccaggagacaaaauaacauucgaagcaacuggaaaucuagugguaccgagauaugcauuugcaauggaaagaaaugcuggaucugguauuaucauuucggauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcaggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38900 - RNA, 1701 nt, Artificial Sequence
  hemagglutinin__InfluenzaA__AFF57128
augaaggcaauacuaguaguucugcuauauacauuugcaaccgccaaugcagacacauuauguauagguuaucaugcgaacaauucaacagacacuguagacacaguacuagaaaagaauguaacaguaacacauucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaccgcugaccaacaaaguaucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucggauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggauggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuguuggaaaaugaaagaacuuuggacuaccacgauucaaaugugaagaacuuauaugaaaagguaagaaaccaguuaaaaaacaaugccaaggaaauugggaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38901 - RNA, 1701 nt, Artificial Sequence
  hemagglutinin__InfluenzaA__AFF57132
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguucucgugcuauggggcauucaccauccaucuacuacugcugaccaacaaaguaucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugagacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 38902 - RNA, 1701 nt, Artificial Sequence
  hemagglutinin__InfluenzaA__AFF57136
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagucuacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38903 - RNA, 1701 nt, Artificial Sequence
  hemagglutinin__InfluenzaA__AFF57144
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugaugaccaacaaagucucuaucagaaugaagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38904 - RNA, 1701 nt, Artificial Sequence
  hemagglutinin__InfluenzaA__AFF57148
augaaggcaauacuaguaguucugcuauauacauuugcaaccgcaaaugcagacacauuauguauagguuaucaugcgaacaauucaacagacacuguagacacauuacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugaugaccaacaaagucucuaucagaaugaagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38905 - RNA, 1701 nt, Artificial Sequence
  hemagglutinin__InfluenzaA__AFF57160
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcgaauccuacauuaaugauaaagggaaagaaguccucgugcuauggggcauucaccauccaucuacuagugcugaccaacaaagucucuaucagaaugaagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38906 - RNA, 1701 nt, Artificial Sequence
  hemagglutinin__InfluenzaA__AFF57164
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgagaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38907 - RNA, 1701 nt, Artificial Sequence; identical to SEQ ID NO: 38906
  hemagglutinin__InfluenzaA__AFF57168

SEQ ID NO: 38908 - RNA, 1701 nt, Artificial Sequence
  hemagglutinin__InfluenzaA__AFF57172
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugaagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38909 - RNA, 1701 nt, Artificial Sequence
  hemagglutinin__InfluenzaA__AFF57176
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagaaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38910 - RNA, 1701 nt, Artificial Sequence
  hemagglutinin__InfluenzaA__AFF57184
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagaaaauucauaccaaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38911 - RNA, 1701 nt, Artificial Sequence; identical to SEQ ID NO: 38903
  hemagglutinin__InfluenzaA__AFF57188

SEQ ID NO: 38912 - RNA, 1707 nt, Artificial Sequence
  hemagglutinin__InfluenzaA__AFF60787
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucuaauuuugagagauuguaguguagcuggauggcuccucggaaacccaaugugugacgaauucaucaaugugccggaaugguccuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccgaaguaaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuaguaugccauuccacaauauacacccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggaacuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaaugggucguuacaaugcagaauuugcauuuaa

SEQ ID NO: 38913 - RNA, 1701 nt, Artificial Sequence
  hemagglutinin__InfluenzaA__AFG29042
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacauuuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguuggugcuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38914 - RNA, 1701 nt, Artificial Sequence
  hemagglutinin__InfluenzaA__AFG29044
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuugauauggcuaguuaaaaaaggaaauucauacccaaagcucagcaaauccuacauuaaugauaaagggaaagaaguccucgugcuauggggcauucaccauccaccuacuaguacugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38915 - RNA, 1701 nt, Artificial Sequence; identical to SEQ ID NO: 33803
  hemagglutinin__InfluenzaA__AFG31060

SEQ ID NO: 38916 - RNA, 1701 nt, Artificial Sequence; identical to SEQ ID NO: 37610
  hemagglutinin__InfluenzaA__AFG31070

SEQ ID NO: 38917 - RNA, 1701 nt, Artificial Sequence
  hemagglutinin__InfluenzaA__AFG31080
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaaggacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38918 - RNA, 1701 nt, Artificial Sequence
  hemagglutinin__InfluenzaA__AFG31100
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacuugaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugauagucucccugggggcaaucaguuucuggaugugcucuaaugggucucuacaguguagaauauguauuuaa

SEQ ID NO: 38919 - RNA, 1701 nt, Artificial Sequence; identical to SEQ ID NO: 33803
  hemagglutinin__InfluenzaA__AFG31110

SEQ ID NO: 38920 - RNA, 1701 nt, Artificial Sequence
  hemagglutinin__InfluenzaA__AFG31120
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuuuuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38921 - RNA, 1701 nt, Artificial Sequence; identical to SEQ ID NO: 38920
  hemagglutinin__InfluenzaA__AFG31130

SEQ ID NO: 38922 - RNA, 1701 nt, Artificial Sequence; identical to SEQ ID NO: 38920
  hemagglutinin__InfluenzaA__AFG31140

SEQ ID NO: 38923 - RNA, 1701 nt, Artificial Sequence; identical to SEQ ID NO: 34679
  hemagglutinin__InfluenzaA__AFG31150

SEQ ID NO: 38924 - RNA, 1701 nt, Artificial Sequence; identical to SEQ ID NO: 34679
  hemagglutinin__InfluenzaA__AFG31160

SEQ ID NO: 38925 - RNA, 1701 nt, Artificial Sequence
  hemagglutinin__InfluenzaA__AFG31170
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggcuacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagaucacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacaugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38926 - RNA, 1701 nt, Artificial Sequence; identical to SEQ ID NO: 38925
  hemagglutinin__InfluenzaA__AFG31180

SEQ ID NO: 38927 - RNA, 1701 nt, Artificial Sequence; identical to SEQ ID NO: 33173
  hemagglutinin__InfluenzaA__AFG31190

SEQ ID NO: 38928 - RNA, 1701 nt, Artificial Sequence; identical to SEQ ID NO: 33173
  hemagglutinin__InfluenzaA__AFG31200

SEQ ID NO: 38929 - RNA, 1701 nt, Artificial Sequence
  hemagglutinin__InfluenzaA__AFG31210
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugacaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38930 - RNA, 1701 nt, Artificial Sequence; identical to SEQ ID NO: 38929
  hemagglutinin__InfluenzaA__AFG31220

SEQ ID NO: 38931 - RNA, 1701 nt, Artificial Sequence; identical to SEQ ID NO: 37610
  hemagglutinin__InfluenzaA__AFG31230

SEQ ID NO: 38932 - RNA, 1701 nt, Artificial Sequence
  hemagglutinin__InfluenzaA__AFG31240
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggagaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38933 - RNA, 1701 nt, Artificial Sequence
  hemagglutinin__InfluenzaA__AFG31250
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagaucuuggcgaucuauucaacugucgccaguucauugguacugguagucucccugggggcaaucaguuucuggaugugcucuaaugggucucuacaguguagaauauguauuuaa

SEQ ID NO: 38934 - RNA, 1701 nt, Artificial Sequence; identical to SEQ ID NO: 33990
  hemagglutinin__InfluenzaA__AFG31260

SEQ ID NO: 38935 - RNA, 1701 nt, Artificial Sequence; identical to SEQ ID NO: 33990
  hemagglutinin__InfluenzaA__AFG31270

SEQ ID NO: 38936 - RNA, 1701 nt, Artificial Sequence
  hemagglutinin__InfluenzaA__AFG31280
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaaccuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 38937 - RNA, 1701 nt, Artificial Sequence; identical to SEQ ID NO: 33990
  hemagglutinin__InfluenzaA__AFG31290

SEQ ID NO: 38938 - RNA, 1701 nt, Artificial Sequence
  hemagglutinin__InfluenzaA__AFG31300
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugacaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauaaauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38939 - RNA, 1701 nt, Artificial Sequence
  hemagglutinin__InfluenzaA__AFG31310
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38940 - RNA, 1701 nt, Artificial Sequence; identical to SEQ ID NO: 38929
  hemagglutinin__InfluenzaA__AFG31323

SEQ ID NO: 38941 - RNA, 1701 nt, Artificial Sequence; identical to SEQ ID NO: 38929
  hemagglutinin__InfluenzaA__AFG31333

SEQ ID NO: 38942 - RNA, 1701 nt, Artificial Sequence; identical to SEQ ID NO: 34753
  hemagglutinin__InfluenzaA__AFG31343

SEQ ID NO: 38943 - RNA, 1701 nt, Artificial Sequence; identical to SEQ ID NO: 34753
  hemagglutinin__InfluenzaA__AFG31353

SEQ ID NO: 38944 - RNA, 1701 nt, Artificial Sequence; identical to SEQ ID NO: 34753
  hemagglutinin__InfluenzaA__AFG31363

SEQ ID NO: 38945 - RNA, 1701 nt, Artificial Sequence; identical to SEQ ID NO: 34753
  hemagglutinin__InfluenzaA__AFG31376

SEQ ID NO: 38946 - RNA, 1701 nt, Artificial Sequence; identical to SEQ ID NO: 34753
  hemagglutinin__InfluenzaA__AFG31386

SEQ ID NO: 38947 - RNA, 1701 nt, Artificial Sequence; identical to SEQ ID NO: 34753
  hemagglutinin__InfluenzaA__AFG31396

SEQ ID NO: 38948 - RNA, 1701 nt, Artificial Sequence; identical to SEQ ID NO: 34753
  hemagglutinin__InfluenzaA__AFG31406

SEQ ID NO: 38949 - RNA, 1701 nt, Artificial Sequence
  hemagglutinin__InfluenzaA__AFG31416
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccgguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38950 - RNA, 1701 nt, Artificial Sequence; identical to SEQ ID NO: 38949
  hemagglutinin__InfluenzaA__AFG31426

SEQ ID NO: 38951 - RNA, 1701 nt, Artificial Sequence; identical to SEQ ID NO: 38949
  hemagglutinin__InfluenzaA__AFG31436

SEQ ID NO: 38952 - RNA, 1701 nt, Artificial Sequence; identical to SEQ ID NO: 38949
  hemagglutinin__InfluenzaA__AFG31446

SEQ ID NO: 38953 - RNA, 1701 nt, Artificial Sequence; identical to SEQ ID NO: 38949
  hemagglutinin__InfluenzaA__AFG31456

SEQ ID NO: 38954 - RNA, 1701 nt, Artificial Sequence; identical to SEQ ID NO: 38949
  hemagglutinin__InfluenzaA__AFG31466

SEQ ID NO: 38955 - RNA, 1701 nt, Artificial Sequence; identical to SEQ ID NO: 34572
  hemagglutinin__InfluenzaA__AFG31486

SEQ ID NO: 38956 - RNA, 1701 nt, Artificial Sequence
  hemagglutinin__InfluenzaA__AFG31496
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38957 - RNA, 1701 nt, Artificial Sequence
  hemagglutinin__InfluenzaA__AFG31506
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuucuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38958 - RNA, 1701 nt, Artificial Sequence; identical to SEQ ID NO: 34753
  hemagglutinin__InfluenzaA__AFG31516

SEQ ID NO: 38959 - RNA, 1701 nt, Artificial Sequence
  hemagglutinin__InfluenzaA__AFG31526
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaauaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccuaaagagcacacagaaugccauugacgagauuacuaacaaaguaaauucuguuauugaaaagaugaauacacaauucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaucacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcuaucuauucaacugucgccaguucauugguacugguagucucccugggggcaaucaguuucuggaugugcucuaaugggucucuacaguguagaauauguauuuaa

SEQ ID NO: 38960 - RNA, 1701 nt, Artificial Sequence
  hemagglutinin__InfluenzaA__AFG31536
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacaugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38961 - RNA, 1701 nt, Artificial Sequence; identical to SEQ ID NO: 37610
  hemagglutinin__InfluenzaA__AFG31546

SEQ ID NO: 38962 - RNA, 1701 nt, Artificial Sequence; identical to SEQ ID NO: 37610
  hemagglutinin__InfluenzaA__AFG31556

SEQ ID NO: 38963 - RNA, 1701 nt, Artificial Sequence; identical to SEQ ID NO: 34753
  hemagglutinin__InfluenzaA__AFG31566

SEQ ID NO: 38964 - RNA, 1701 nt, Artificial Sequence; identical to SEQ ID NO: 35277
  hemagglutinin__InfluenzaA__AFG31586

SEQ ID NO: 38965 - RNA, 1701 nt, Artificial Sequence; identical to SEQ ID NO: 35277
  hemagglutinin__InfluenzaA__AFG31596

SEQ ID NO: 38966 - RNA, 1701 nt, Artificial Sequence; identical to SEQ ID NO: 35277
  hemagglutinin__InfluenzaA__AFG31606

SEQ ID NO: 38967 - RNA, 1701 nt, Artificial Sequence; identical to SEQ ID NO: 35277
  hemagglutinin__InfluenzaA__AFG31616

SEQ ID NO: 38968 - RNA, 1701 nt, Artificial Sequence; identical to SEQ ID NO: 35277
  hemagglutinin__InfluenzaA__AFG31626

SEQ ID NO: 38969 - RNA, 1701 nt, Artificial Sequence; identical to SEQ ID NO: 34753
  hemagglutinin__InfluenzaA__AFG31636

SEQ ID NO: 38970 - RNA, 1701 nt, Artificial Sequence
  hemagglutinin__InfluenzaA__AFG31646
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuagacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38971 - RNA, 1701 nt, Artificial Sequence
  hemagglutinin__InfluenzaA__AFG31656
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagaguacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38972 - RNA, 1701 nt, Artificial Sequence
  hemagglutinin__InfluenzaA__AFG31666
augaaggcaauacuaguaguucugcuauauacauuugcaacugcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagaguacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38973 - RNA, 1701 nt, Artificial Sequence
  hemagglutinin__InfluenzaA__AFG71865
augaagaccaucauugcuuugagcuacauuuucugucuggcucucggccaagaccuuccaggaaaugacaacagcacagcaacgcugugccugggacaucaugcggugccaaacggaacacuagugaaaacaaucacaaaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguaucgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcaccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggugcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggaacuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 38974 - RNA, 1701 nt, Artificial Sequence
  hemagglutinin__InfluenzaA__AFG71876
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauaaacugcacacugauagaugcucuauugggggacccucauugugauguuuuucaagaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcaggcuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 38975 - RNA, 1701 nt, Artificial Sequence
  hemagglutinin__InfluenzaA__AFG71898
augaagaccaucauugcuuugagcuaccuuuucugucuggcuuucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuccaaaaugagacaugggaccuuuucguugaacgcagcaaagcuuucagcaacuguuacccuuaugauguaccagauuaugccucccuuaggucacuaguugccucgucaggcacucuggaguuuaccacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugucaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguguuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 38976 - RNA, 1701 nt, Artificial Sequence
  hemagglutinin__InfluenzaA__AFG71920
augaagaccaucauugcuuugagcuacauuuucugucuggcucucggccaagaccuuccaggaaaugacaacaguacagcaacgcugugccugggacaucaugcggugccaaacggaacacuagugaaaacaaucacaaaugaucagauugaagugacuaaugcuacugagcuaguucagagcuccucaacggggaaaauaugcaacaauccucaucgaauccuugauggaauaaacugcacacugauagacgcucuauugggggacccucauugugauguuuuccaagaugagacaugggaccuuuucguugaacgcagcaaagcuuucagcaacuguuacccuuaugaugugccagauuaugccucccuuaggucacuaauugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaaaccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaauuggcaacagggaugcggaauguaccagagaaacaaacuagaggccuauucggcgcaauagcaggcuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucugaaguagaagggagaauucaggaccucgagaaauacguugaagacacuaaaauagaucucuggucuuacaaugcagagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 38977 - RNA, 1701 nt, Artificial Sequence
  hemagglutinin__InfluenzaA__AFG71931
augaagaccaucauugcuuugagcuacauuuucugucugguuaucggccaagaccuuccaggaaaugaaaacagcacagcaacgcugugccugggacaucaugcagugccaaacggaacacuagugaaaacaaucacaaaugaucagauugaagugacuaaugcuacugagcuaguucagagcuccucaacggggaaaauaugcaacaauccucaucgaauccuugauggaauagacugcacacugauagaugcucuauugggggacccucauugugaugguuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguaucgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaacaucgggucuagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaauaggguaauugagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaucugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucauguuuuuugcuuuguguuguuuugcugggguucaucaugugggccugccagagaggcaacauuaggugcaacauuugcauuuga

SEQ ID NO: 38978 - RNA, 1701 nt, Artificial Sequence
  hemagglutinin__InfluenzaA__AFG71942
augaagaccaucauugcuuugagcuacauuuucuaucuggcucucagccaagaccuuccaggaaaugacaacagcaaagcaacgcugugccugggacaucaugcggugccaaacggaacacuagugaaaacaaucacagaugaucagacugaagugacuaaugcuacugagcuaguucagagcuccucaacggggaaaauaugcaacaauccucaucgaauccuugauggaauggacugcacacugauagaugcucuauugggggacccucauugugauguuuuucaaaaugagacaugggaccuuuucguugaacgcagcaaagcuuucagcaacuguuacccuuaugaugugccagauuaugccucccuuagaucacuaguugccucgucaggcacucuggaguuuauuacugaggguuucacuuggacugaggucacucagaaugggggaagcauugcuugcaaaaggggaccugauagcgguuuuuucaguagacugaacugguugaccaaaucaggaagaacauauccagugcugaacgugacuaugccaaacaaugacaauuuugacaaacuauacauuugggggguucaccacccgagcacggaccaagaacaaaccaaccuguauguucaaacaucagggagagucacagucucuaccaggagaagccagcaaacuauaaucccgaauaucggauccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugauaaacccuuucaaaacguaaacaagaucacauauggagcaugccccaaauauguuaagcaaaacacccugaaguuggcaacaggaaugcggaauguaccagagaaacaaacuagaggccuauucggcgcaauagcaggcuucauagaaaaugguugggagggaaugauagacgguugguacgguuucaggcaucaaaauucugagggcacaggacaagcagcagaucuuaaaagcacucaagcagccauugaccaaaucaauggaaaauugaacaggauaaucgagaagacgaacgagaaauuccaucaaaucgaaaaggaauucucagaaguagaaggaagaauucaggaccucgagaaauacguugaagacacuaaaauagaucuauggucuuacaaugcagagcuucuugucgcucuggagaaucaacauacaauugaucugacugacucggaaaugaacaaacuguuugaaaaaacaagaaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaacagguuucaaaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 38979 - RNA, 1701 nt, Artificial Sequence
  hemagglutinin__InfluenzaA__AFG71953
augaagaccaucauugcuuugagcuacauuuucugucugguucucggccaagaccuuccaggaaaugacaaaagcacagcaacgcugugccugggacaccaugcagugccaaacggaacacuagugaaaacaaucacaaaugaucagauugaagugacuaaugcuacugagcugguucagagcuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguaggcugaacugguugaccaaaucaggaagcacauauccagugcugaacgugacuaugccaaacaaugacaauuuugacaaacuauacauuugggggguucaccacccgagcacgaaccaagaacaaaccagccuguauguacaagcaucagggagagucacagucuccaccaagagaagccagcaaacuauaaucccgaauaucgggucuagacccuggguaagggguccgucuagcagaauaagcaucuauuggacaacaguuaaaccgggagacauacugauaaucaauaguaaugggaaccuaauugcuccucgggguuauuucaaaaugcgaacugggaaaagcucaauaaugaggucagaugcaccuauuggugccuguauuucugaaugcaucacuccaaauggaagcauucccaaugacaagcccuuucaaaauguaaacaagaucacauauggggcaugccccaaguauguuaagcaaaacacccugaaguuggcaacagggaugcggaauguaccagagaaacaaacuagaggccuauucggagcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggggucaucaugugggccugccagaaaggcaacauuaggugcaacauuugcauuuga

SEQ ID NO: 38980 - RNA, 1701 nt, Artificial Sequence
  hemagglutinin__InfluenzaA__AFG71975
augaagacuaucauugcuuugagcuacauuuucugucugguucucggccaagauuuuccaggaaaugacaacagcacagcaacgcugugccugggacaucaugcggugccaaacggaacacuagugaaaacaaucacaaaugaucagauugaagugacuaaugcuacugagcugguucagaguuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaaggcuucacuuggacuggggucacucagaaugggggaagcaaugcuugcaaaaggggaccugauagcgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccagccuauauguucaagcaucagggagagucacagucucuaccaagagaagccagcaaacuauaaucccgaauaucggaucuagacccuggguaaggggucugucuaguagaauaagcaucuauuggacaauaguuaaaccaggagacauacugguaauuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacucugaaguuggcaacagggaugcgaaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 38981 - RNA, 1701 nt, Artificial Sequence
  hemagglutinin__InfluenzaA__AFG71996
augaagacuaucauugcuuugagcuacauuuucugucugguucucggccaaaacuuuccaggaaaugacaacagcacagcaacgcugugccugggacaucaugcggugccaaacggaacacuagugaaaacaaucacaaaugaucagauugaagugacuaaugccacugagcugguucagaguuccucaacgggaaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaaggcuucacuuggacuggggucacucagaaugggggaagcaaugcuugcaaaaggggaccugauaucgguuuuuucaguagacugaacugguuguacaaaucaggaaacacauauccagugcugaacgugaguaugccaaacaaugacaauuuugacaaacuauacauuugggggguucaccacccgagcacggaccaagaacaaaccagccuauauguucaagcaucagggagagucacagucuccaccaagagaagccagcaaacuauaaucccgaauaucgggucuagacccuggguaaggggucugucuaguagaauaagcaucuauuggacaauaguuaaaccgggagacauacugguaauuaauagcaaugggaacuuaauugcuccucgggguuacuucaaaaugcgcacuggaaaaagcucaauaaugaggucagaugcaucuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggauaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcuggguuucaucaugugggccugccagaaaggcaacauuaggugcaacauuugcauuuga

SEQ ID NO: 38982 - RNA, 1701 nt, Artificial Sequence
  hemagglutinin__InfluenzaA__AFG72007
augaagacuaucauugcuuugagcuacauuuucugucugguucucggccgagacuuuccaagaaaugacaacagcacagcaacgcugugccugggacaucaugcggugccaaauggaacacuagugaaaacaaucacaaaugaucagauugaagugacuaaugcuacugaacugguucagaguuccucaacggggaaaauaugcaauaauccucaucgaauccucgauggaauggacugcacacugauagaugcucuauugggggacccucauugugauggccuucaaaaugggacaugggaccuuuucguugaacgcagcaaagcuuucagcaacuguuacccuuaugaugugccagauuaugccucccuuaggucacuaguugccucgucuggcacucuggaguuuaucaaugaaggcuucacuuggacuggggucacucagaaugggggaagcaaugcuugcaaaaggggaccugauagcgguuuuuucaguagacugaacugguuguacaaaucaggaaacacauauccaguacugaacgugacuaugccaaacaaugacaauuuugacaaacuauacauuugggggguucaccacccgagcacggaccaagaccaaaccagccuauauguucaagcaucagggagagucacagucuccaccaagagaagccagcaaacuguaaucccgaauaucgggccuagacccuggguaaggggucugucuaguagaauaagcaucuauuggacaauaguuaaaccgggagacauacuguuaauuaauaguaauggaaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacagggcaagcagcagaucuuaaaagcacucaagcagccaucgaccaaaucaauggaaaacugaauaggguaaucgagaagacgaacgagaaauuccaucaaaucgaaaaggaguucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacagaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 38983 - RNA, 1701 nt, Artificial Sequence
  hemagglutinin__InfluenzaA__AFG72029
augaagacuaucauugcuuugagcuacauuuucugucugguuuucggccaaaaccuucccggaaaugacaacagcacagcaacgcugugccugggacaccaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuucaaaaugagaaaugggaccuuuuuguugaacgcagcaaagcuuucagcaacuguuacccuuaugaugugccagauuaugccucccuuaggucacuaauugccucgucaggcacccuggaguuuaucaaugaaggcuucaauuggacuggagucacucagagugggggaagcuaugcuugcaaaaggggaucugauaacaguuucuucaguagacugaauugguuguacgaaucagaaagcaaauauccagugcugaacgugacuaugccaaacaauggcaauuuugacaaacuguacauuugggggguucaccacccgagcacggacaaagaacaaaccaaccuauauguucgagcaucagggagagucacagucucuaccaagagaagccagcagaccauaaucccgaauaucgggucuagacccuggguaaggggucugucuaguagaauaaguaucuauuggacaauaguaaaaccgggagacauacuguuaauuaauaguaaugggaaccuaauugcuccuagggguuacuucaaaauacgcacugggaaaagcucaauaaugaggucagaugcaccuauuggcaccugcaguucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauacguugaagacacuaaaauagaucucuggucuuacaacgcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuaa

SEQ ID NO: 38984 - RNA, 1701 nt, Artificial Sequence
  hemagglutinin__InfluenzaA__AFG72040
augaagacuaucauugcuuugagcuacauuuucugucugguuuucgcccaaaaccuucccggaaaugacaacagcacagcaacgcugugccugggacaccaugcagugccaaacggaacgcuagugaaaacaaucacgaaugaucagauugaagugacuaaugcuacugagcugguucagaguuccucaacagguagaauaugcgacaguccucaccggauccuugaugggaaaaacugcacacugguagaugcucuauugggagacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuaucaaugaaagcuucaauuggacuggagucacucagagugggggaagcuaugcuugcaaaagaggaucugauaacaguuucuucaguagacugaauugguuguacgaaucagaaagcaaauauccagugcugaacgugacuaugccaaacaauggcaauuuugacaaacuguacauuugggggguucaccacccgagcacggacaaagaacaaaccaaccuauauguucgagcaucagggagagucacagucucuaccaagagaagccagcaaacuauaaucccgaauaucgggucuagacccuggguaaggggucugucuagcagaauaagcaucuauuggacaauaguaaaaccgggagacauacuguuaauuaauaguaaugggaaccuaauugcuccucgggguuacuucaaaauacgcacugggaaaagcucaauaaugaggucagaugcaccuauuggcaccugcaguucugaaugcaucacuccaaauggaagcauucccaaugacaagcccuuucaaaauguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagccgcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauacguugaaaacacuaaaauagaucucuggucuuacaacgcggagcuucuugucgcucuggagaaccaacauacaauugaucugacugacucggaaaugaacaaacuguuugaaaaaacaaggaggcaacugagggaaaaugcugaggacaugggcaauggcugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 38985 - RNA, 1701 nt, Artificial Sequence
  hemagglutinin__InfluenzaA__AFG72051
augaagacuaucauugcuuuaagcuacauuuucugucugguuuucgcccaaaaccuucccggaaaugacaacagcacagcaacgcugugccugggacaccaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugguagaugcucuauugggagacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuaucaaugaaagcuucaauuggacuggagucacucagagugggggaagcuaugcuugcaaaaggggaucugauaacaguuucuucaguagacugaauugguuguacgaaucagaaagcaaauauccagugcugaacgugacuaugccaaacaauggcaauuuugacaaacuguacauuugggggguucaccacccgagcacggacaaagaacaaaccaaccuauauguucgagcaucagggagagucacagucucuaccaagagaaaccagcaaacuguaaucccgaauaucgggucuagacccuggguaaggggucugucuagcagaauaagcaucuauuggacaauaguaaaaccgggagacauacugcuaauuaauaguaaugggaaccuaauugcuccucgggguuacuucaaaauacacaaugggaaaagcucaauaaugaggucagaugcaccuauuggcaccugcaguucugaaugcaucacuccaaauggaagcauucccaaugacaagcccuuucaaaauguaaacaagaucacauauggggcaugucccaaguacguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucgaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauacguugaagacacuaaaauagaucucuggucuuacaacgcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuucuugcuuuguguuguuuugcugggguucaucaugugggccugccaaaaaggcaacauuaggugcaacauuugcauuuga

SEQ ID NO: 38986 - RNA, 1701 nt, Artificial Sequence
  hemagglutinin__InfluenzaA__AFG72085
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggauuggagucacucagagugggggaagcugugcuugcaaaaggggaucuguuaacaguuucuucaguagauugaauugguugcacgaaucagaacaaaaauauccagcgcugaacgugacuaugccaaacaauggcaaauuugacaaauuguacauuugggggguucaccacccgagcacggacagagaacaaaccaaccuauauguucgagcaucagggagagucacagucucuaccaagagaagccagcaaacuguaaucccgaauaucgggucuagacccuggguaaggggucuguccaguagaauaagcaucuauuggacaauaguaaaaccgggagacauacuguugauuaauagcaucgggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 38987 - RNA, 1701 nt, Artificial Sequence
  hemagglutinin__InfluenzaA__AFG72107
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaauugccucaucaggcacccuggaguuuaucaaugaagaauucaauuggacuggagucacucagaaugggggaagcuaugcuugcaaaaggggaucuguuaacaguuucuucaguagauugaauugguugcaugaaucagaauacaaauauccagcgcugaacgugacuaugccaaacaauggcagauuugacaaauuguacauuugggggguucaccacccuagcacggacagagaacaaaccaaccuauauguucgagcaucagggagagucacagucuccaccaaaagaagccagcaaacuguaaucccgaauaucgggccuagacccuggguaaggggucuguccaguagaauaagcaucuauuggacaauaguaaaaccgggggacauacuguugauuaauagcacugggaaccuaauugcuccucgggguuacuucaaaauacacacugggaaaagcucaauaaugaggucagaugcaccuauuggcaccugcaguucugaaugcaucacuccaaauggaagcauccccaaugacaaacccuuucaaaauguaaacaagaucacauauggggcaugucccagguauguuaagcaaaacacucuaaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaagaaagcaacugagggaaaaugcugaggacaugggcaaugguugcuucaaaauauaccacaaaugugacaaugcuugcauagggucaaucagaaauggaacuuaugaccaugauguauacagagacgaagcaguaaacaaccgguuccagaucaaagguguugagcugaagucaggauacaaagacuggauccuauggauuuccuuugccauaucaugcuuuuugcuuuguguuauuuugcugggauucaucaugugggccugccaaaaaggcaacauuaggugcaacauuugcauuuga

SEQ ID NO: 38988 - RNA, 1701 nt, Artificial Sequence
  hemagglutinin__InfluenzaA__AFG72118
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugaguugguucagaauuccucaacagguagaauaugcaacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagagugggggaagcuaugcuugcaaaaggggaucuguuaacaguuucuucaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucuaccaaaagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgaacuggaaaaagcucaauaaugaggucagaugcacccauuggcaccugcaguucugaaugcaucaccccaaauggaagcauucccaaugacaaacccuuucaaaauguaaacaggaucacauauggggcaugucccagauauguuaagcaaaacacucugaaauuggcaacagggaugcggaauguaccggagagacaaacuaggggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuauaaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 38989 - RNA, 1701 nt, Artificial Sequence
  hemagglutinin__InfluenzaA__AFG72129
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagagugggggaagcuaugcuugcaaaaggggaucuguuaacaguuucuuuaguagauugaauugguugcacgaaucagaauacaaauauccagcgcugaacgugacuaugccaaacaauggcaaauuugacaaauuguacauuugggggguucaccacccgagcacggauagagaacaaaccaaccuauauguucgagcaucagggagagucacagucucuaccaaaagaagccagcaaacugugaucccgaauaucgggucuagacccuggguaaggggucuguccaguggaauaagcaucuauuggacaauaguaaaaccgggagacauacuguugauuaauagcaccgggaaccuaauagcuccucgggguuacuucaaaauacgaacugggaaaagcucaauaaugaggucagaugcacccauuggcaccugcaguucugaaugcaucacuccaaauggaagcauucccaaugacaaacccuuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 38990 - RNA, 1701 nt, Artificial Sequence
  hemagglutinin__InfluenzaA__AFG72140
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuucaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagagugggggaagcuaugcuugcaaaaggggaucuguuaacaguuucuuuaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcauuagggagagucacagucucaaccaaaagaagccagcaaacuguaaucccgaauaucgggucuagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucaauaaugaggucagaugcacccauuggcaccugcaguucugaaugcaucacuccaaauggaagcauucccaauaacaaacccuuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcagagcuucuugucgcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 38991 - RNA, 1701 nt, Artificial Sequence
  hemagglutinin__InfluenzaA__AFG72151
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 38992 - RNA, 1701 nt, Artificial Sequence
  hemagglutinin__InfluenzaA__AFG72184
augaagacuaucauugcuuugagcuacaucuuaugucugguuuucgcccaaaaacuucccggaaaugacaacagcacagcaacgcugugccuggggcaucaugcagugccaaacggaacucuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugaugacuuccaaaauaaggaaugggaccuuuuuguugaacgcagcaaagcuuacagcaacuguuacccuuaugaugugccagauuaugccucccuuaggucacuaguugccucaucaggcacccuggaauuuaucaaugaagacuucaauuggacuggagucgcucagaguggggaaagcuaugcuugcaaaaggggaucuguuaaaaguuucuuuaguagauugaauugguugcacgaaucagaauacaaauauccagcgcugaacgugacuaugccaaacaaugacaaauuugacaaauuguacauuugggggguucaccacccgagcacggaaagagaacaaaccagccuauauauucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaccuaauugcuccuagggguuacuucaaaauacgaacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaauagagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 38993 - RNA, 1701 nt, Artificial Sequence
  hemagglutinin__InfluenzaA__AFG72195
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaaccuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 38994 - RNA, 1701 nt, Artificial Sequence
  hemagglutinin__InfluenzaA__AFG72206
augaagacuaucauugcuuugagcuacauucuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguaaaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagaguggggaaagcuaugcuugcaaaaggggaucuguuaaaaguuucuuuaguagauugaauuggcugcacgaaucagauuacaaauauccagcgcugaacgugacuaugccaaacaauggcaaauuugacaaauuguacauuugggggguucaccacccgagcacggacagagaacaaaccagccuauauauucgagcaucagggagagucacagucuccaccaaaagaagccaacaaacugugaucccgaauaucggguccagacccugggugaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuauuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 38995 - RNA, 1701 nt, Artificial Sequence
  hemagglutinin__InfluenzaA__AFG72217
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugaguugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaccccgaauaucgggucuagacccuggguaaggggucuguccaguagaauaagcaucuauuggacaauaguaaaaccgggagacauacuuuugauuaguagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagauauuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuugauccuauggauuuccuuugccauaucaugcuuuuugcuuuguguuguuuugcugggguucaucaugugggccugccaaaaaggcaacauuaggugcaacauuugcauuuga

SEQ ID NO: 38996 - RNA, 1701 nt, Artificial Sequence
  hemagglutinin__InfluenzaA__AFG72228
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagagcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaaccuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 38997 - RNA, 1701 nt, Artificial Sequence
  hemagglutinin__InfluenzaA__AFG72239
augaagacuaucauugcuuugagcuacauuuuaugucugguucucgcccaaaaacuucccggaagugacaacagcacagcaacgcugugccugggacaucaugcagugccaaacggaacgcuagugaaaacaaucacgaaugaucaaauugaagugacuaaugcuacugagcugguucagaguuccacaacagguagaauaugugacaguccucaccgaauccuugauggaaaaaauugcacacugauagaugcucuauugggagacccucauugugauggcuuccaaaauaaggaaugggaucuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaaccuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 38998 - RNA, 1701 nt, Artificial Sequence
  hemagglutinin__InfluenzaA__AFG72272
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacaggaaugcggaauguaccagagaaacaaacuagaggcauauucggugcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 38999 - RNA, 1701 nt, Artificial Sequence
  hemagglutinin__InfluenzaA__AFG72316
augaagacuaucauugcuuugagccacauuuuaugucugguuuucgcucaaaaacuucccggaaaugacaacagcacagcaacgcuaugccugggacaucaugcagugccaaacggaacgcuagugaaaacaaucacgaaugaucaaauugaagugacuaaugcuacugaguugguucagaguucuucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaauuuaucaaugaagacuucaauuggacuggagucgcucaggaugggggaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaccccgaauaucgggucuagacccuggguaaggggucuguccaguagaauaagcaucuauuggacaauaguaaaaccgggagacauacuuuugauuaauagcacaggaaaucuaauugcuccucgggguuacuucaaaauacgaaaugggaaaagcucaauaaugaggucagauguacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguaugguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguggaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39000 - RNA, 1701 nt, Artificial Sequence
  hemagglutinin__InfluenzaA__AFG72339
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugucucccuuaggucacuaguugccucaucaggcacccuggaguuuaucaaugaagacuucaauuggacuggagucgcucaggaugggggaagcuauacuugcaaaaggggaucuguuaacaguuucuuuaguagauugaauugguugcacaaaucagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaccccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaccugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaccuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39001 - RNA, 1701 nt, Artificial Sequence
  hemagglutinin__InfluenzaA__AFG72350
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugucucccuuaggucacuaguugccucaucaggcacccuggaguuuaucaaugaagacuucaauuggacuggagucgcucaggaugggagaagcuaugcuugcaaaaggggaucuguuaacaguuucuuuaguagauugaauugguugcacaaaucagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaccccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaucugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaccuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39002 - RNA, 1701 nt, Artificial Sequence
  hemagglutinin__InfluenzaA__AFG72372
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuauacuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugaacugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39003 - RNA, 1701 nt, Artificial Sequence; identical to SEQ ID NO: 31529
  hemagglutinin__InfluenzaA__AFG72383

SEQ ID NO: 39004 - RNA, 1701 nt, Artificial Sequence
  hemagglutinin__InfluenzaA__AFG72394
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucgcuaccaaaagaagccaacaaacuguaaucccgaauaucggguuuagacccuggguaaggggucaguccaguggaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuucaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39005 - RNA, 1701 nt, Artificial Sequence
  hemagglutinin__InfluenzaA__AFG72405
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucacagaauccuugauggaaaaaacugcacacugauagaugcucuauugggagacccuaauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucaggaugggggaagcuaugcuugcaaaaggggaucuguuaaaaguuucuuuaguagauugaauugguugcacaaauuagaauacaaauauccagcgcugaacgugacuaugccaaacaauggcaaauucgacaaauuguacauuugggggguucaccacccgagcacggacagugaccaaaccagccuauauguucgagcaucagggagagucacagucucuaccaaaagaagccaacaaacuguaaccccgaauaucgggucuagacccuggguaaggggucuguccaguagaauaagcaucuauuggacaauaguaaaaccgggagacauacuuuugauuaauagcacaggaaaucuaauugcuccucgggguuacuucaaaauacgaaaugggaaaagcucaauaaugaggucagaugcacccauuggcaccugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaaccgacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39006 - RNA, 1701 nt, Artificial Sequence
  hemagglutinin__InfluenzaA__AFG72449
augaagacuaucauugcuuugagcuacauuuuaugucugguuuucgcucaaaaacuucccggaaaugacaacagcacagcaacgcugugccugggacaccaugcggugccaaacggaacgcuagugaaaacaaucacgaaugaucaaauugaagugacuaaugcuacugagcugguucagaguuccucaacagguagaauaugcuacaguccucaccgaauccuugauggaaacaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaaagguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggggagucacagucucuaccaaaagaagccaacaaacuguaaucccgaguaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39007 - RNA, 1701 nt, Artificial Sequence
  hemagglutinin__InfluenzaA__AFG72460
augaagacuaucauugcuuugagcuacauuuuaugucugguguucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuguauguucgagcaucagggagagucacagucucuaccaaaagaagccaacaaacuguaaucccgaauaucgggucuagacccuggguaaggggccuguccaguagaauaagcaucuauuggacaauaguaaaaccgggagacauacuuuugauuaauagcacagggaaucuaauugcuccucgggguuacuucaaaauacgaaaugggaaaaguucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucagaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauaggaucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39008 - RNA, 1701 nt, Artificial Sequence
  hemagglutinin__InfluenzaA__AFG72504
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaaaaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaauuaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39009 - RNA, 1701 nt, Artificial Sequence
  hemagglutinin__InfluenzaA__AFG72515
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggagagucacagucucuaccaaaagaagccaacaaacuguaaucccggauaucggguauagaccauggguaaggggucuguccaguagaauaagcaucuauuggacaauaguaaaaccgggagacauacuucugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcugcagaucuuaaaagcacucaagcagcaaucgaccaaaucaacgggaagcugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuguuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauucuauggauuuccuuugccauaucaugcuuuuugcuuuguguuguuuugcuuggguucaucaugugggccugccaaaaaggcaacauuaggugcaacauuugcauuuga

SEQ ID NO: 39010 - RNA, 1701 nt, Artificial Sequence
  hemagglutinin__InfluenzaA__AFG72526
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcagcuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaucacccgagcacggacagugaccagaccagccuauauguucgagcaucagggagagucauagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuuuaaaauacgaacugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggaaggaaugguagacgguugguacgguuucaggcaucaaaauucugagggcacaggacaagcagcagaucuuaaaagcacucaaacagcaaucaaccaaaucaacgggaaacugaauagguugaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39011 - RNA, 1701 nt, Artificial Sequence
  hemagglutinin__InfluenzaA__AFG72581
augaagaccaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaacggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggggagucacagucucuaccaaaagaagccaacaaacuguaaucccgaauaucggguauagacccuggguaaggggucuguccaguagaauaagcaucuauuggacaauaguaaaaccaggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauuuccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaguucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugccgaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39012 - RNA, 1701 nt, Artificial Sequence
  hemagglutinin__InfluenzaA__AFG72603
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaggugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugagcgcagcaaagcuuacagcaacuguuacccuuaugaugugccggauuaugccucccuuagaucacuaguugccucaucaggcacccuggaguuuaccaaggaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucgggucuagacccuggguaagggguaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauuggcaacugcaaaucugaaugcaucacuccaaauggaagcauucccaaugacaaaccuuuucaaaauguaaacaggaucacauauggggccugucccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaccgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39013 - RNA, 1701 nt, Artificial Sequence
  hemagglutinin__InfluenzaA__AFG72614
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaccaaugaaggcuucaauuggacuggagucgcucaggauggaacaagcuauucuugcaaaaggggaucuguuaaaaguuucuuuaguagauugaauugguugcacaaauuagaauacaaauauccagcacugaacguggcuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39014 - RNA, 1701 nt, Artificial Sequence
  hemagglutinin__InfluenzaA__AFG72625
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggagugggaccuuuuuguugaacgcagcaaagcuuacagcaacuguuacccuuaugaugugccggauuaugcuucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaagggguaucuccagcagaauaagcaucuauuggacaauaguaaaaccgggagacauacuuuugauuaaaagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39015 - RNA, 1701 nt, Artificial Sequence
  hemagglutinin__InfluenzaA__AFG72636
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacaaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugcuucccuuaggucacuaguugccucaucaggcacccuggaguuuaccaaugaaggcuucaauuggacuggagucgcucaggaugggaaaagcuaugcuugcaaaaggggaucuguuaaaaguuucuuuaguagauugaauugguugcacaaauuagaauucaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucggguccagacccugggugagggguaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaccaaaauucugagggcacaggacaagcagcagaucuuaaaagcacucaagcagcaaucgaucaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuaggguucaucaugugggcaugccaaaaaggcaacauuaggugcaacauuugcauuuga

SEQ ID NO: 39016 - RNA, 1701 nt, Artificial Sequence
  hemagglutinin__InfluenzaA__AFG72658
augaagacuaucauugcuuugagcuacauuuuaugucuggcuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggagucgcucaggaugggaaaagcuaugcuugcaaaaggggaucuguuaacaguuucuuuaguagauugaauugguuacacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucggguccagacccugggugaggggcaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39017 - RNA, 1701 nt, Artificial Sequence
  hemagglutinin__InfluenzaA__AFG72680
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguauaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaaugugacuaugccaaacaaugacaaauuugacaaauuguacauuugggggguucaccacccgaguacggacagugaccaaaccagccuauauguucaagcaucagggagagucacagucucuaccagaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacaggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagggacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39018 - RNA, 1701 nt, Artificial Sequence
  hemagglutinin__InfluenzaA__AFG72691
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuucaaaaauaaggaaugggaccuuuuuguugaacgcagcacagcuuacagcaacuguuacccuuaugaugugccggauuaugccucccuuaggucacuaguugccucauccggcacccuggaguuuaccaaugaaggcuucaauuggacuggagucgcucaggauggaacaagcuaugccugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaauggcaaaccuuuucaaaauguaaacaggaucacauauggggccugucccagauauguuaagcaaaacacucuaaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaagaaagcaacugagggaaaaugcugaggacaugggcaaugguugcuucaaaauauaucacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39019 - RNA, 1701 nt, Artificial Sequence
  hemagglutinin__InfluenzaA__AFG72713
augaagauuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugaugggaaaaacugcacacugauagaugcucuauugggagacccucauugugauggcuucaaaaauaaggaaugggaccuuuuuguugaacgcagcacagcuuacagcaacuguuacccuuaugaugugccggauuaugccucccuuaggucacuaguugccucaucgggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaagggguaucuccagcagaauaagcaucuauuggacaauaguaaaaccgggagacauacuuuugauuagcagcacagggaaucuaauugcuccucgggguuacuucaaaauacgaagugggaaaagcucaauaauaaggucggaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuccuuguugcccuggagaaccaacauacaauugaucuaacugacucagaaaugaacaaacuguuugaaagaacaagaaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39020 - RNA, 1701 nt, Artificial Sequence
  hemagglutinin__InfluenzaA__AFG72724
augaagacuaucauugcuuugagcuacauucuaugucugguuuucgcucaaaaacuucccggaaaugacaacagcacggcaacgcugugccugggacaccaugcagugccaaacggaacgcuagugaaaacaaucacaaaugaccaaauugaaguuacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaccaaugaaggcuucaauuggacuggaguugcucaggauggaacaagcuaugcuugcaaaaggggaucuguuaaaaguuucuuuaguagauugaauugguugcacaaauuagaauacaaauauccagcacugaacguuacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguuaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugucugcauagggucaaucagaaauggaacuuaugaccaugauguauacagagacgaagcauuaaacaaucgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39021 - RNA, 1701 nt, Artificial Sequence
  hemagglutinin__InfluenzaA__AFG72735
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuucaaaaauaaggaaugggaccuuuuuguugaacgcagcacagcuuacagcaacuguuacccuuaugaugugccggauuaugccucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaccgugacuaugccaaacaaugacaaauuugacaaauuguacauuugggggguucaccacccgaguacggacagugaccaaaccagcauauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucuaaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagauaucuggucuuacaacgcggagcuucuuguugcccuggagaaccaacauacaauugaucuaacugacucagaaaugaacaaacuguuugaaagaacaagaaagcaacugagggaaaaugcugaggacaugggcaaugguugcuucaaaauauaucacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39022 - RNA, 1701 nt, Artificial Sequence
  hemagglutinin__InfluenzaA__AFG72757
augaagacuaucauugcuuugagcuacauuuuaugucugguuuucgcucaaaaaauucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggaguucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagcauauaugcucaagcaucagggagagucacagucucuaccaaaagaagccaacaaacuguaaucccgaauaucggaucuagacccuggguaagggguaucuccagcagaauaagcauccauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39023 - RNA, 1701 nt, Artificial Sequence
  hemagglutinin__InfluenzaA__AFG72779
augaagacuaucauugcuuugagcuacauuuuaugucugguuuucgcucaaaaacuucccggaaaugacaacagcacggcaacgcugugccugggacaccaugcagugccaaacggaacguuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagauccauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccagaagaagccaacaaacuguaaucccgaacaucggaucuagacccuggguaaggggugucuccagcggaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcauuacuccaaauggaagcauucccaaugacaaaccauuucaaaauguaaacagaaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccaaaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39024 - RNA, 1701 nt, Artificial Sequence
  hemagglutinin__InfluenzaA__AFG72801
augaagacuaucauugcuuugagcuacauuuuaugucugguuuucgcucaaaaacuucccggaaaugacaacagcacggcaacgcugugccuggggcaccaugcagugucaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagcauauaugcucaaucaucagggagagucacagucucuaccaaaagaagccaacaaacuguaaucccgaauaucggaucuagucccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39025 - RNA, 1701 nt, Artificial Sequence
  hemagglutinin__InfluenzaA__AFG72812
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucuaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 39026 - RNA, 1701 nt, Artificial Sequence
  hemagglutinin__InfluenzaA__AFG72823
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccgguacacuggaguuuaacaaugaaagcuucaauuggacuggagucacucagaauggaacaagcucugcuugcaaaaggagaucuaauaaaaguuucuuuaguagauugaauugguugacccauuuaaaauacaaauacccagcauugaacgugacuaugccaaacaaugaaaaauuugacaaauuguacauuugggggguucuccacccggguacggacagugaccaaaucagccuauaugcucaagcaucaggaagaaucacagucucuaccaaaagaagccaacaaacuguaaucccgaauaucggaucuagacccaggguaaggggugucuccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauauuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39027 - RNA, 1701 nt, Artificial Sequence
  hemagglutinin__InfluenzaA__AFG72834
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauagugaaaccgggagacauacuuuugauuaacagcacagggaaucuaauugcuccucgggguuacuucaaaauacaaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacacacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 39028 - RNA, 1701 nt, Artificial Sequence
  hemagglutinin__InfluenzaA__AFG72845
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaagauacaaauauccagcacugaacgugacuaugccaaacaaugaaaaauuugacaaauuguacauuugggggguccaccacccggguacagacagugaccaaaucagccuauaugcucaagcaucagggagagucacaaucucuaccaaaagaagccaacaaacuguaaucccgaauaucggaucuagacccuggguaaggggugucuccagcagaauaagcauccauuggacaauaguaaaaccgggggacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaaaacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguugauugagaaaacgaaugagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaggcauugaacaaccgguuccagaucaaagguguugagcugaagucaggauacaaagauuggauccuauggauuuccuuugccauaucauguuuuuugcuuuguauuguuuuacugggguucaucaugugggccugccaaaaaggcaacauuaggugcaacauuugcauuuga

SEQ ID NO: 39029 - RNA, 1701 nt, Artificial Sequence
  hemagglutinin__InfluenzaA__AFG72856
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaccaaugaaagcuucaauuggacuggagucacucagaauggaacaagcucugcuugcaaaaggagaucuaauaaaaguuucuuuaguagauugaauugguugacccauuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauaaguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 39030 - RNA, 1701 nt, Artificial Sequence
  hemagglutinin__InfluenzaA__AFG72867
augaagacuaucauagcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaauuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucuaauaaaaguuucuuuaguagauugaauugguugcaccaauuaaaaaacaaauauccagcgcugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauuccuaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaccaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 39031 - RNA, 1701 nt, Artificial Sequence
  hemagglutinin__InfluenzaA__AFG72922
augaagacuaucauugcuuugagcuacauucuaugucugguuuucgcucaaaaacuuccuggagaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucuucuugcauaaggaaaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaagauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39032 - RNA, 1701 nt, Artificial Sequence
  hemagglutinin__InfluenzaA__AFG72933
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcguaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggcaugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39033 - RNA, 1701 nt, Artificial Sequence
  hemagglutinin__InfluenzaA__AFG72955
augaagacuaucauugcuuugagcuacauucuaugucugguuuucgcucaaaaacuuccuggaaaugacaacagcacggcaacgcugugccuugggcaccaugcaguaccaaacggaacgauagugaaaacaauaacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcauaaggagaucuaauaacaguuucuuuaguagauuaaauugguugacccacuuaagauucaaguacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacaccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucggaaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucaggaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39034 - RNA, 1701 nt, Artificial Sequence
  hemagglutinin__InfluenzaA__AFG98808
augaagaccaucauugcuuugagcuacauuuucugucuggcucucggccaagaccuuccaggaaaugacaacagcacagcaacgcugugucugggacaucaugcggugccaaacggaacacuagugaaaacaaucacaaaugaucagauugaagugacuaaugcuacugagcuaguucagagcuccucaacggggaaaauaugcaacaauccucaucgaauccuugauggaauaaacugcacacugauagacgcucuauugggggacccucauugugauguuuuucaagaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcaggcuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 39035 - RNA, 1701 nt, Artificial Sequence
  hemagglutinin__InfluenzaA__AFG98819
augaagaccaucauugcuuugagcuacauuuucugucuggcucucggccaagaccuuccaggaaaugacaacagcacagcaacgcugugccugggacaucaugcggugccaaacggaacacuagugaaaacaaucacaaaugaucagauugaagugacuaaugcuacugagcuaguucagagcuccucaacggggaaaauaugcaacaauccucaucgaauccuugauggaauaaacugcacacugauagacgcucuauugggggacccucauugugauguuuuucaagaugagacaugggaccuuuucguugaacgcagcaaagcuuucagcaacuguuacccuuaugaugugccagauuaugccucccuuaggucacuaguugccucaucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaaaccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcaggcuucauagaaaaugguugggagggaaugauagacgguugguacgguuucaggcaucaaaauucugagggcacaggacaagcagcagaucuuaaaagcacucaagcagccaucgaccaaaucaaugggaaauugaacagaguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggagacaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcaucuga

SEQ ID NO: 39036 - RNA, 1701 nt, Artificial Sequence
  hemagglutinin__InfluenzaA__AFG98830
augaagaccaucauugcuuugagcuacauuuucugucugguucucggccaagaccuuccaggaaaugacaaaagcacagcaacgcugugccugggacaucaugcggugccaaacggaacacuagugaaaacaaucacaaaugaucagauugaagugacuaaugcuacugagcugguucagagcuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcagugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguacaagcaucagggagagucacagucucuaccaggagaagccagcaaacuauaaucccgaauaucgggucuagacccuggguaaggggucugucuaguagaauaagcaucuauuggacaauaguuaaaccgggagacauacugauaauuaauaguaaugggaaccuaauugcuccucgggguuauuucaaaaugcgcacugggaaaagcucaauaaugaggucagaugcaccuauugauaccuguauuucugaaugcaucacuccaaauggaagcauucccaaugacaagcccuuucaaaauguaaacaagaucacauauggggcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaucugacugacucggaaaugaacaagcuguuugaaaaaacaaggaggcaacugagggaaaaugcugaagacaugggcaaugguugcuucaaaauauaccacaaaugugacaacgcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39037 - RNA, 1701 nt, Artificial Sequence
  hemagglutinin__InfluenzaA__AFG98841
augaagaccaucauugcuuugagcuacauuuucugucugguucucggccaagaccuuccaggaaaugacaaaagcacagcaacgcugugccugggacaucaugcggugccaaacggaacacuagugaaaacaaucacaaaugaucagauugaagugacuaaugcuacugagcugguucagagcuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugauguaccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguacaagcaucagggagagucacagucucuaccaggagaagccagcaaacuauaaucccgaauaucgggucuagacccuggguaaggggucugucuaguagaauaagcaucuauuggacaauaguuaaaccgggagacauacugauaauuaauaguaaugggaaccuaauugcuccucgggguuauuucaaaaugcgcacugggaaaagcucaauaaugaggucagaugcaccuauugguaccuguauuucugaaugcaucacuccaaauggaagcauucccaaugacaagcccuuucaaaauguaaacaagaucacauauggggcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaagcuguuugaaaaaacaaggaggcaacugagggaaaaugcugaagacaugggcaaugguugcuucaaaauauaccacaaaugugacaacgcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39038 - RNA, 1701 nt, Artificial Sequence
  hemagglutinin__InfluenzaA__AFG98852
augaagacuaucauugcuuugagcuacauuuucugucugguucucggccaagacuuuccaggaaaugacaacagcacagcaacgcugugccugggacaucaugcggugccaaacggaacacuagugaaaacaaucacaaaugaucagauugaagugacuaaugcuacugagcugguucagaguuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggaacucuggaguuuaucaaugaaggcuucacuuggacuggggucacucagaaugggggaagcaaugcuugcaaaaggggaccugauagcgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccagccuauauguucaagcaucagggagagucacagucucuaccaagagaagccagcaaacuauaaucccgaauaucgggucuagacccuggguaaggggucugucuaguagaauaagcaucuauuggacaauaguuaaaccaggagacauacugguaauuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacgaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39039 - RNA, 1701 nt, Artificial Sequence
  hemagglutinin__InfluenzaA__AFG98863
augaagacuaucauugcuuugagcuacauuuucugucugguucucggccaagaucuuccaggaaaugacaacagcacagcaacgcugugccugggacaucaugcggugccaaacggaacacuagugaaaacaaucacaaaugaucagauugaagugacuaaugcuacugagcugguucagagcuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaggguuucacuuggacuggggucacucagaaugggggaagcagugcuugcaaaaggggaccugauagcgguuuuuucaguagacugaacugguuguacaaaucaggaagcacauauccagugcugaacgugacuaugccaaacaaugacaauuuugacaaacuauacauuugggggguucaccacccgagcacgaaccaagaacaaaccagccuauauguucaagcaucagggagagucacagucucuaccaagagaagccagcaaacuauaaucccgaauaucgggucuagacccuggguaaggggucugucuaguagaauaagcaucuauuggacaauaguuaaaccgggagacauacugguaauuaauaguaaugggaaccuaauugcuccucgggguuauuucaaaaugcgcacugggaaaagcucaauaaugaggucagaugcaccuauugguaccuguauuucugaaugcaucacuccaaauggaagcauucccaaugacaaacccuuucaaaacguaaacaagaucacauauggggcaugucccaaguauguuaagcaaaacacccugaaguuggcaacagggaugcggaauguaccagagaaacaaacuagaggccuauucggcgcaauagcagguuucauagaaaaugguugggagggaaugauagacgguugguacggcuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaagcuguuugaaaaaacaaggaggcaacugagggaaaaugcugaggacaugggcaaugguugcuucagaauauaccacaaaugugacaaugcuugcauagggucaaucagaaaugggacuuaugaccaugauguauacagagacgaagcauuaaacaaccgguuucagaucaaagguguugaacugaaaucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39040 - RNA, 1701 nt, Artificial Sequence
  hemagglutinin__InfluenzaA__AFG98874
augaagacuaucauugcuuugagcuacauuuucugucugguucucggccaagauuuuccaggaaaugacaacagcacagcaacgcugugccugggacaucaugcggugccaaacggaacacuagugaaaacaaucacaaaugaucagauugaagugacuaaugcuacugagcugguucagaguuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaaggcuucacuuggacuggggucacucagaaugggggaagcaaugcuugcaaaaggggaccugauaacgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccagccuauauguucaagcaucagggagagucacagucucuaccaagagaagccagcaaacuauaaucccgaauaucgggucuagacccuggguaaggggucugucuaguagaauaagcaucuauuggacaauaguuaaaccaggagacauacugguaauuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggagcaugucccaaguauguuaagcaaaacacccugaaguuggcaacagggaugcgaaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39041 - RNA, 1701 nt, Artificial Sequence
  hemagglutinin__InfluenzaA__AFG98885
augaagacuaucauugcuuugagcuacauuuucugucugguucucggccaagacuuuccagggaaugacaacagcacagcaacgcugugccugggacaucaugcggugccaaacgggacacuagugaaaacaaucacaaaugaucagauugaagugacuaaugcuacugagcugguucagaguuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucuucaggcacucuggaguuuaucaaugaaggcuucacuuggacuggggucacucagaaugggggaagcaaugcuugcaaaaggggaacugauagcgguuuuuucaguagacugaacugguuguacaaaucaggaagcacauacccagugcugaacgugacuaugccaaacaaugacaauuuugacaaacuauacauuugggggguucaccacccgagcacggaccaagaacaaaccagccuauauguucaagcaucagggagagucacagucucuaccaagagaagccagcaaacuauaaucccgaauaucgggucuagacccuggguaaggggucugucuaguagaauaagcaucuauuggacaauaguuaaaccaggagacauacugguaauuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauugaacaaccgguuucagaucaaagguguugaacugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39042 - RNA, 1701 nt, Artificial Sequence
  hemagglutinin__InfluenzaA__AFG98896
augaagacuaucauugcuuugagcuacauuuucugucugguucucggccaagacuuuccaggaaaugacaacagcacagcaacgcugugccugggacaucaugcggugccaaacggaacacuagugaaaacaaucacaaaugaucagauugaagugacuaaugcuacugagcugguucagaguuccucaacggguaaaauaugcaacaauccucaucgaauccuugauggaauaaacugcacacugauagaugcucuguugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaaggcuucacuuggacuggggucacucagaaugggggaagcaaugcuugcaaaaggggaccugauagcgguuuuuucaguagacugaacugguuguacaaaucaggaagcgcauauccagugcugaacgugacuaugccaaacaaugacaauuuugacaaacuauacauuugggggguucaccacccgagcacggaccaagaacaaaccaaccuauauguucaaacaucagggagagucacagucuccacaaagagaagccagcaaacuauaaucccgaauaucgggucuagacccuggguaaggggucugucuaguagaauaagcaucuauuggacaauaguuaaaccgggagacauacugguaauuaauaguaaugggaaccuaauugcuccucgggguuacuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39043 - RNA, 1701 nt, Artificial Sequence
  hemagglutinin__InfluenzaA__AFG98907
augaagacuaucauugcuuugagcuacauuuucugucugguucucggccaagaccuuccaggaaaugacaacagcacagcaacgcugugccugggacaucaugcggugccaaacggaacgcuagugaaaacaaucacgaaugaucagauugaagugacuaaugcuacugagcugguucagaguuccucaacggguaaaauaugcaacaauccucaucgaauccuugauggaauaaacugcacacugauagaugcucuauugggggacccucauugugauggcuuucaaaaugagaaaugggaccuuuuuguugaacgcagcaaagcuuucagcaauuguuacccuuaugaugugccagauuaugccucccuuaggucacuaguugccucgucaggcacucuggaguuuaucaaugaaggcuucaauuggacuggggucacucagaaugggggaagcaaugcuugcaaaaggggaccugacugcgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccaaccuauauguucaagcaucagggagagucacagucuccaccaagagaagccagcaaacuauaaucccgaauaucgggucuagacccuggguaaggggucugucuaguagaauaagcaucuauuggacaauaguuaaaccgggagacauacugguaauuaauaguaaugggaaccuaauugcuccucgggguuacuucaaaaugcgcacugggaaaagcucaauaaugaggucagaugcaccuauuggcaccugcauuucugaaugcaucacuccaaacggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuauaaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39044 - RNA, 1701 nt, Artificial Sequence
  hemagglutinin__InfluenzaA__AFG98918
augaagacuaucauugcuuugagcuacauuuucugucugguucucggccaagaccuuccaggaaaugacaacagcacagcaacgcugugccugggacaucaugcggugccaaacggaacgcuagugaaaacaaucacgaaugaucagauugaagugacuaaugcuacugagcugguucagaguuccucaacggguaaaauaugcaacaauccucaucgaauccuugauggaauaaacugcacacugauagaugcucuauugggggacccucauugugauggcuuucaaaaugagaaaugggaccuuuuuguugaacgcagcaaagcuuucagcaauuguuacccuuaugaugugccagauuaugccucccuuaggucacuaguugccucgucaggcacucuggaguuuaucaaugaaggcuucaauuggacuggggucacucagaaugggggaagcaaugcuugcaaaaggggaccugacagagguuuuuucaguagacugaacugguuguacaaaucaggaagcacauauccagugcugaacgugacuaugccaaacaaugacaauuuugacaaacuauacauuugggggguucaccacccgagcacggaccaagaacaaaccaaccuauauguucaagcaucagggagagucacagucuccaccaagagaagccagcaaacuauaaucccgaauaucgggucuagacccuggguaaggggucugucuaguagaauaagcaucuauuggacaauaguuaaaccgggagacauacugguaauuaauaguaaugggaaccuaauugcuccucgggguuacuucaaaaugcgcacugggaaaagcucaauaaugaggucagaugcaccuauuggcaccugcauuucugaaugcaucacuccaaacggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuauaaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39045 - RNA, 1701 nt, Artificial Sequence
  hemagglutinin__InfluenzaA__AFG98929
augaagacugucauugcuuugagcuacauuuucugucugguucucggccaagaccuuccaggaaaugacaacagcacagcaacgcugugccugggacaucaugcggugccaaacggaacgcuagugaaaacaaucacgaaugaucagauugaagugacuaaugcuacugagcugguucagaguuccucaacggguaaaauaugcaacaauccucaucgaauccuggauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcaaugcuugcaaaagaggaccugacaucgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccaaccuauauguucaagcaucagggagagucacagucuccaccaagagaagccagcaaacuauaaucccgaauauugggucuagacccuggguaaggggucugucuaguagaauaagcaucuauuggacaauaguuaaaccgggagacauacugguaauuaauaguaaugggaaccuaauugcuccucgggguuacuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguaugugaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuauaaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39046 - RNA, 1701 nt, Artificial Sequence
  hemagglutinin__InfluenzaA__AFG98940
augaagacuaucauugcuuugagcuacauuuucugucugguucucggccaagaccuuccaggaaaugacaacagcacagcaacgcugugccugggacaucaugcggugccaaacggaacgcuagugaaaacaaucacgaaugaucagauugaagugacuaaugcuacugagcugguucagaguuccucaacggguaaaauaugcaacaauccucaucgaauccuugauggaauaaacugcacacugauagaugcucuauugggggacccccauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcaaugcuugcaaaaggggaccugacagcgguuuuuucaguagacugaacugguuguacaaaucaggaagcacauauccagugcugaacgugacuaugccaaacaaagacaauuuugacaaacuauacauuugggggguucaccacccgagcacggaccaagaacaaaccaaccuauauguucaagcaucagggagagucacagucuccaccaagagaagccagcaaacuauaaucccgaauaucgggucuagacccuggguaagggguaugucuaguagaauaagcaucuauuggacaauaguuaaaccgggagacauacugguaauuaauaguaaugggaaccuaauugcuccucgggguuacuucaaaaugcgcacugggagaagcucaauaaugaggucagaugcaccuauuggcaccugcauuucugaaugcaucacuccaaauggaagcauucccaaugacaggcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagagucaaucagaaaugggacuuauaaccaugauguauacagagacgaagcauuaaacaaccgguuucagaucaaagguguugaacugaagucaggguacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39047 - RNA, 1701 nt, Artificial Sequence
  hemagglutinin__InfluenzaA__AFG98962
augaagacuaucauugcuuugagcuacauuuucugucugguucucgcccaagaccuuccaggaaaugacaacagcacagcaacgcugugccugggacaucaugcggugccaaacggaacgcuagugaaaacaaucacgaaugaucagauugaagugacuaaugcuacugagcugguucagagcuccucaacggguaaaauaugcaacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcaaugcuugcaaaaggggaccugauagcgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccaaccuauauguucaagcaucagggagagucacagucuccaccaagagaagccagcaaacuauaaucccuaauguugggucuagacccuggguaaggggucugucuaguagaauaagcaucuauuggacaauaguuaaaccgggagacauacugguaauuaauaguaaugggaaccuaauugcuccucgggguuacuucaaaaugcgcacugggaaaagcucaauaaugaggucagaugcaccuauuggcaccugcaguucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauagaguaaucgagaagacgaacgagaaauuccaccaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugccgaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39048 - RNA, 1701 nt, Artificial Sequence
  hemagglutinin__InfluenzaA__AFG98973
augaagacuaucauugcuuugagcuacauuuucugucugguucucggccaagacuuuccaagaaaugacaacagcacagcaacgcugugccugggacaucaugcggugccaaauggaacacuagugaaaacaaucacaaaugaucagauugaagugacuaaugcuaaugaacugguucagaguuccucaacggggaaaauaugcaauaauccucaucgaauccucgauggaauggacugcacacugauagaugcucuauugggggacccucauugugauggccuucaaaaugagacaugggaccuuuucguugaacgcagcaaagcuuucagcaacuguuacccuuaugaugugccagauuaugccucccuuaggucacuaguugccucgucuggcacucuggaguuuaucaaugaaggcuucacuuggacuggggucacucagaaugggggaagcaaugcuugcaaaaggggaccugauagagguuuuuucaguagacugaacugguuguacaaaucaggaaacacauauccaguacugaacgugacuaugccaaacaaugacaauuuugacaaacuauacauuugggggguucaccacccgagcacggaccaagaccaaaccagccuauauguucaagcaucagggagagucacagucuccaccaagagaagccagcaaacuguaaucccgaauaucgggccuagacccuggguaaggggucugucuaguggaauaagcaucuauuggacaauaguuaaaccgggagacauacuguuaauuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacagggcaagcagcagaucuuaaaagcacucaagcagccaucgaccaaaucaauggaaaacugaauaggguaaucgagaagacgaacgagaaauuccaucaaaucgaaaaggaguucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacagaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39049 - RNA, 1701 nt, Artificial Sequence
  hemagglutinin__InfluenzaA__AFG98984
augaagacuaucauugcuuugagcuacauuuucugucugguucucggccaagacuuuccaagaaaugacaacagcacagcaacgcugugccugggacaucaugcggugccaaauggaacacuagugaaaacaaucacaaaugaucagauugaagugacuaaugcuacugaacugguucagaguuccucaacggggaaaauaugcaauaauccucaucgaauccucgauggaauggacugcacacugauagaugcucuauugggggacccucauugugauggccuucaaaaugagacaugggaccuuuucguugaacgcagcaaagcuuucagcaacuguuacccuuaugaugugccagauuaugccucccuuaggucacuaguugccucgucuggcacucuggaguuuaucaaugaaggcuucacuuggacuggggucacucagaaugggggaagcaaugcuugcaaaaggggaccugauagagguuuuuucaguagacugaacugguuguacaaaucaggaaacacauauccaguacugaacgugacuaugccaaacaaugacaauuuugacaaacuauacauuugggggguucaccacccgagcacggaccaagaccaaaccagccuauauguucaagcaucagggagagucacagucuccaccaagagaagccagcaaacuguaaucccgaauaucgggccuagacccuggguaaggggucugucuaguggaauaagcaucuauuggacaauaguuaaaccgggagacauacuguuaauuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacagggcaagcagcagaucuuaaaagcacucaagcagccaucgaccaaaucaauggaaaacugaauaggguaaucgagaagacgaacgagaaauuccaucaaaucgaaaaggaguucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacagaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39050 - RNA, 1704 nt, Artificial Sequence
  hemagglutinin__InfluenzaA__AFG98995
augaagacuaucauugcuuugagcuacauuuucugucugguuuucgcccaagaccuuccaggaaaugacaacaacagcacagcaacgcugugccugggacaucaugcggugccaaacggaacgcuagugaaaacaaucacgaaugaucagauugaagugacuaaugcuacugagcugguucagaguuccucaacggguaaaauaugcaacaauccucaucgaauccuugauggaauaaacugcacacugauagaugcucuauugggggacccucauugugauggauuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcaaugcuugcaaaagaggaccugauaucgguuuuuucaguagacugaacugguuguacaaaucaggaagcacauauccagugcaaaacgugaccaugccaaacaaugacaauucugacaaacuauacauuugggggguucaccacccgagcacggacaaagaacaaaccgaccuauauguucaagcaucagggaaagucacagucuccaccaagagaagccagcaaacuauaaucccgaaugucgggucuagacccuggguaaggggucugucuaguagaauaagcaucuauuggacaauaguuaaaccgggagacauacugguaauuaauaguaaugggaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauuccgagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39051 - RNA, 1701 nt, Artificial Sequence
  hemagglutinin__InfluenzaA__AFG99006
augaagacuaucauugcuuugagcuacauuuucugucugguucucggccaagacuuuccaagaaaugacaacagcacagcaacgcugugccugggacaucaugcggugccaaauggaacacuagugaaaacaaucacaaaugaucagauugaagugacuaaugcuacugaacugguucagaguuccucaacggggaaaauaugcaacaauccucaucgaauccucgauggaauggacugcacacugauagaugcucuauugggggacccucauugugauggccuucaaaaugagacaugggaccuuuucguugaacgcagcaaagcuuucagcaacuguuacccuuaugaugugccagauuaugccucccuuaggucacuaguugccucgucuggcacucuggaguuuaucaaugaaggcuucacuuggacuggggucacucagaaugggggaagcaaugcuugcaaaaggggaccugauagagguuuuuucaguagacugaacugguuguacaaaucaggaaacacauauccaguacugaacgugacuaugccaaacaaugacaauuuugacaaacuauacauuugggggguucaccacccgagcacggaccaagaccaaaccagccuauauguucaagcaucagggagagucacagucuccacaaagagaagccagcaaacuguaaucccgaauaucgggccuagacccuggguaaggggucugucuaguagaauaagcaucuauuggacaauaguuaaaccgggagacauacuguuaauuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacagggcaagcagcagaucuuaaaagcacucaagcagccaucgaccaaaucaauggaaaacugaauaggguaaucgagaagacgaacgagaaauuccaucaaaucgaaaaggaguucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacagaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39052 - RNA, 1701 nt, Artificial Sequence; identical to SEQ ID NO: 31268
  hemagglutinin__InfluenzaA__AFG99017

SEQ ID NO: 39053 - RNA, 1701 nt, Artificial Sequence
  hemagglutinin__InfluenzaA__AFG99028
augaagacuaucauugcuuugagcuacauuuucugucugguuuucgcccaagaccuuccaggaaaugacaacagcacagcaacucugugccugggacaucaugcggugccaaacggaacgcuagugaaaacaaucacgaaugaucagauugaagugacuaaugcuacugaacugguucagaguuccucaacggguaaaauaugcggcaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcagugcuugcaaaaggggaccugauaacgguuuuuucaguagacugaacugguuguacaaaucaggaagcacauauccagugcagaacgugaccaugccaaacaaugacaacucugacaaacuauacauuugggggguucaccacccgagcacggacaaagaacaaaccgaccuauauguucaagcaucagggaaagucacagucuccaccaagagaagccagcaaacuguaaucccgaaugucgggucuagacccuggguaaggggucugucuaguagaguaagcaucuauuggacaauaguuaaaccgggagacauacugguaauuaauaguaauggaaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39054 - RNA, 1701 nt, Artificial Sequence
  hemagglutinin__InfluenzaA__AFG99039
augaagacuaucauugcuuugagcuacauuuucugucugguuuucgcccaagaccuuccaggaaaugacaacagcacagcaacucugugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcagugcuugcaaaaggggaccugauaacgguuuuuucaguagacugaacugguuguacaaaucaggaagcacauauccagugcagaacguggccaugccaaacaaugacaacucugacaaacuauacauuugggggguucaccacccgagcacggacaaagaacaaaccgaccuauauguucaagcaucagggaaagucacagucuccaccaagagaagccagcaaacuguaaucccgaaugucgggucuagacccuggguaaggggucugucuaguagaguaagcaucuauuggacaauaguuaaaccgggagacauacugguaauuaauaguaauggaaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuauuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39055 - RNA, 1701 nt, Artificial Sequence
  hemagglutinin__InfluenzaA__AFG99050
augaagacuaucauugcuuugagcuacauuuucugucugguuuucgcccaagaccuuccaggaaaugacaacagcacagcaacucugugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcagugcuugcaaaaggggaccugauaacgguuuuuucaguagacugaacugguuguacaaaucaggaagcacauauccagugcagaacgugaccaugccaaacaaugacaacucugacaaacuauacauuugggggguucaccacccgagcacggacaaagaacaaaccgaccuauauguucaagcaucagggaaagucacagucuccaccaagagaagccagcaaacuguaaucccgaaugucgggucuagacccuggguaaggggucugucuaguagaguaagcaucuauuggacaauaguuaaaccgggagacauacugguaauuaauaguaauggaaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacuaaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39056 - RNA, 1701 nt, Artificial Sequence
  hemagglutinin__InfluenzaA__AFG99061
augaagacuaucauugcuuugagcuacauuuucugucugguuuucgcccaagaccuuccaggaaaugacaacagcacagcaacucugugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcagugcuugcaaaaggggaccugauaacgguuuuuucaguagacugaacugguuguacaaaucaggaagcacauauccagugcagaacgugaccaugccaaacaaugacaacucugacaaacuauacauuugggggguucaccacccgagcacggacaaagaacaaaccgaccuauauguucaagcaucagggaaagucacagucuccaccaagagaagccagcaaacuguaaucccgaaugucgggucuagacccuggguaaggggucugucuaguagaguaagcaucuauuggacaauaguuaaaccgggagacauacugguaauuaauaguaauggaaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauauuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaagguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcccuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39057 - RNA, 1701 nt, Artificial Sequence
  hemagglutinin__InfluenzaA__AFG99072
augaagacuaucauugcuuugagcuacauuuucugucugguuuucgcccaagaccuuccaggaaaugacaacagcacagcaacucugugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaaaaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuagaucacuaguugccucgucaggcacucuggaguuuaucaaugaaggcuucaauuggacuggggucacucagaaugggggaagcagugcuugcaaaaggggaccugauaacgguuuuuucaguagacugaacugguuguacaaaucaggaagcacauauccagugcagaacgugaccaugccaaacaaugacaacucugacagacuauacauuugggggguucaccacccgagcacggacaaagaacaaaccgaccuauauguucaagcaucagggaaagucacagucuccaccaagagaagccagcaaacuguaaucccgaaugucgggucuagacccuggguaaggggucugucuaguagaguaagcaucuauuggacaauaguuaaaccgggagacauacugguaauuaauaguaauggaaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaggggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuauaaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39058 - RNA, 1701 nt, Artificial Sequence
  hemagglutinin__InfluenzaA__AFG99083
augaagaccaucauugcuuugagcuacauuuucugucugguuuucgcccaagaccuuccaggaaaugauaacagcacagcaacucugugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaauaaacugcacacugauagaugcucuauugggagacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcagugcuugcaaaaggggaccugauaaagguuuuuucaguagacugaacugguuguacaaaucaggaagcacauauccagugcagaacgugaccaugccaaacaaugacaacucugacaaacuauacauuugggggguucaccacccgagcacggacaaagaacaaaccgaccuauauguucaagcaucagggaaagucacagucuccaccaagagaagccagcaaacuguaaucccgaaugucgggucuagacccuggguaaggggucugucuaguagaguaagcaucuauuggacaauaguuaaaccgggagacauacugguaauuaauaguaauggaaaccuaauugcuccucgggguuacuucaaaaugcucacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacagggcaagcagcagaucuuaaaagcacucaagcagccaucgaucaaaucaaugggaaacugaauaggguaaucgagaagacgaacgagaaauuccaucaaaucgaaaaggaauucucagaaguagaagggagaauucaugaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39059 - RNA, 1701 nt, Artificial Sequence
  hemagglutinin__InfluenzaA__AFG99094
augaagaccaucauugcuuugagcuacauuuucugucugguuuucgcccaagaccuuccaggaaaugacaacagcacagcaacucugugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaauaaauugcacacugauagaugcucuauugggagacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcggugcuugcaaaaggggaccugauaacgguuuuuucaguagacugaacugguuguacaaaucaggaagcacauauccagugcagaacgugaccaugccaaacaaugacaacucugacaaacuauacauuugggggguucaccacccgagcacggacaaagaacaaaccgaccuauauguucaagcaucagggaaagucacagucuccaccaaaagaagccagcaaacuguaaucccgaaugucgggucuagacccuggguaaggggucugucuaguagaguaagcaucuauuggacaauaguuaaaccgggagacauacugguaauuaauaguaauggaaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 39060 - RNA, 1701 nt, Artificial Sequence
  hemagglutinin__InfluenzaA__AFG99116
augaagacuaucauugcuuugagcuacauuuucugucugguuuucgcccaaaaccuucccggaaaugacaacagcacagcaacgcugugccugggacaccaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugguagaugcucuauugggagacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuaucaaugaaagcuucaauuggacuggagucacucagagugggggaagcuaugcuugcaaaaggggaucugauaacaguuucuucaguagacugaauugguuguacgaaucagaaagcaaauauccagugcugaacgugacuaugccaaacaauggcaauuuugacaaacuguacauuugggggguucaccacccgagcacggacaaagaacaaaccaaccuauauguucgagcaucagggagagucacaguaucuaccaagagaagccagcaaacuauaaucccgaauaucgggucuagacccuggguaaggggucugucuagcagaauaagcaucuauuggacaauaguaaaaccgggagacauacuguuaauuaauaguaauggaaaccuaauugcuccucgggguuacuucaaaauacgcacugggaaaagcucaauaaugaggucagaugcaccuauuggcaccugcaguucugaaugcaucacuccaaauggaagcauucccaaugacaagcccuuucaaaauguaaacaagaucacauauggggcaugucccaaguauguuaagcaaaacacucugaaguuggcaacaggaaugcgaaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauacguugaagacacuaaaauagaucucuggucuuacaacgcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39061 - RNA, 1701 nt, Artificial Sequence
  hemagglutinin__InfluenzaA__AFG99127
augaagacuaucauugcuuugagcuacauucucugucugguuuucgcccaaaaccuucccggaaaugacaacagcacagcaacgcugugccugggacaccaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugguagaugcucuauuaggagacccucauugugauggcuuucaaaaugagaaaugggaccucuuuguugaacgcagcaaagcuuucagcaacuguuacccuuaugaugugccagauuaugccucccuuaggucacuaguugccucgucaggcacccuggaguuuaucaaugaaagcuucaauuggacuggagucacucagagugggggaagcuaugcuugcaaaaggggaucugauaacaguuucuucaguagacugaauugguuguacgaaucagaaagcaaauauccagugcugaacgugaccaugccaaacaauggcaauuuugacaaacuguacauuugggggguucaccacccgagcacggacaaagaacaaaccaaccuauauguucgagcaucagggagagucacagucucuaccaagagaagccagcaaacuauaaucccgaauaucggaucuagacccuggguaaggggucugucuagcagaauaagcaucuauuggacaauaguaaaaccgggagacauacuguuaauuaauaguaaugggaaccuaauugcuccucgggguuacuucaaaauacgcacugggaaaagcucaauaaugaggucagaugcaccuauuggcaccugcaguucugaaugcaucacuccaaauggaagcauucccaaugacaagcccuuucaaaauguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauacguugaagacacuaaaauagaucucuggucuuacaacgcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39062 - RNA, 1701 nt, Artificial Sequence
  hemagglutinin__InfluenzaA__AFG99138
augaagacuaucauugcuuuaagcuacauuuucugucugguuuucgcccaaaaccuucccggaaaugacaacagcacagcaacgcugugccugggacaccaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugguagaugcucuauugggagacccccauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuaucaaugaaagcuucaauuggacuggagucacucagagugggggaagcucugcuugcaaaaggggaucugauaacaguuucuucaguagacugaauugguuguacgaaucagaaagcaaauauccagugcugaacgugacuaugccaaacaauggcaauuuugacaaacuguacauuugggggguucaccacccgagcacggacaaagaacaaaccaaccuauauguucgagcaucagggagagucacagucucuaccaagagaaaccagcaaacuguaaucccgaauaucgggucuagacccuggguaaggggucugucuagcagaauaagcaucuauuggacaauaguaaaaccgggagacauacugcuaauuaauaguaaugggaaccuaauugcuccucgggguuacuucaaaauacgcaaugggaaaagcucaauaaugaggucagaugcaccuauuggcaccugcaguucugaaugcaucacuccaaauggaagcauucccaaugacaagcccuuucaaaauguaaacaagaucacauauggggcaugucccaaguacguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucgaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauacguugaagacacuaaaauagaucucuggucuuacaacgcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuucuugcuuuguguuguuuugcugggguucaucaugugggccugccaaaaaggcaacauuaggugcaacauuugcauuuga

SEQ ID NO: 39063 - RNA, 1701 nt, Artificial Sequence
  hemagglutinin__InfluenzaA__AFG99149
augaagacuaucauugccuugagcuacauccucugucugguuuucgcccaaaaccuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuccaaaaugagaaaugggaccuuuuuguugaacgcagcagagcuuucagcaacuguuacccuuaugaugugccagauuaugccucccuuaggucacuaguugccucaucaggcacccuggaguuuaucaaugaaggcuucaauuggacuggagucacucagagugggggaagcuaugcuugcaaaaggggaucugauaacaguuucuucaguagacugaacuggcuguacgaaucagaaagcaaauauccagugcugaacgugacuaugccaaacaauggcaaauuugacaaauuguacauuugggggguucaccacccgagcacggacaaagaacaaaccaaccuauauguucgagcaucagggagagucaccgucucuaccaagagaagccagcaaacuguaaucccgaauaucgggucuagacccuggguaaggggucugucuaguagaauaaguaucuauuggacaauaguaaaaccgggagacauacuguuaauuaauagcacugggaaccuaauugcuccucgggguuacuucaaaauacgcacugggaaaagcucaauaaugaggucagaugcacccauuggcaccugcaguucugaaugcaucacuccaaauggaagcauucccaaugacaagcccuuucaaaacguaaacaagaucacauauggggcaugucccagguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcucuggagaaccaacauacaauugaucugacugacgcagaaaugaacaaacuguuugaaaaaacaaggaagcaacugagggaaaaugcugaggacaugggcaaugguugcuucaaaauauaccacaaaugugacaaugcuugcauagggucaaucagaaauggaacauaugaccaugauguauacagagacgaagcauuaaacaaccgauuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39064 - RNA, 1701 nt, Artificial Sequence
  hemagglutinin__InfluenzaA__AFG99171
augaagacuaucauugcuuuaagcuacauuuucugucugguuuucgcccaaaaccuucccggaaaugacaacagcacggcaacgcugugccugggacaccaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugguagaugcucuauugggagacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuaccaaugaaagcuucaauuggacuggagucacucagagugggggaagcuaugcuugcaaaaggggaucugauaacaguuucuucaguagacugaauugguuguacgaaucagaaagcaaauauccagugcugaacgugacuaugccaaacaauggcaauuuugacaaacuguacauuugggggguucaccacccgagcacggacaaagaacaaaccaaccuauauguucgagcaucagggagagucacagucucuaccaagagaaaccagcaaacuguaaucccgaauaucgggucuagacccuggguaaggggucugucuagcagaauaagcaucuauuggacaauaguaaaaccgggagacauacugcuaauuaauaguaacgggaaccuaauugcuccucgggguuacuucaaaauacgcaaugggaaaagcucaauaaugaggucagaugcaccuauuggcaccugcaguucugaaugcaucacuccaaauggaagcauucccaaugacaagcccuuucaaaauguaaacaagaucacauauggggcaugucccaaguacguuaagcaaaauacucugaaguuggcaacagggaugcggaauguaccagagaaacaaacuagaggcauauucggcgcaauagcagguuucauagaaaaugguugggagggaaugguagacgguugguacgguuucaggcaucgaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauacguugaagacacuaaaauagaucucuggucuuacaacgcggagcuucuugucgcucuggagaaccaacauacaauugaucugacugacucggaaaugaacaaacuguuugaaaaaacaaggaggcaacuaagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuucuugcuuuguguuguuuugcugggguucaucaugugggccugccaaaaaggcaacauuaggugcaacauuugcauuuga

SEQ ID NO: 39065 - RNA, 1701 nt, Artificial Sequence
  hemagglutinin__InfluenzaA__AFG99182
augaagacuaucauugcuuugagcuacauuuucugucugguuuucgcccaaaaacugcccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcacccuggaguuuaucaaugaaggcuucaauuggacuggagucacucagagugggggaagcuaugcuugcaaaaggggaucuguuaacaguuucuucaguagauugaauugguuguacgaaucagaauacaaauauccagcgcugaacgugacuaugccaaacaauggcaaauuugacaaauuguacauuugggggguucaccacccgagcacggacaaagaacaaaccaaccuauauguucgagcaucagggagagucacagucucuaccaagagaagccagcaaacuguaaucccgaauaucgggucuagacccuggguaagaggucuguccaguagaauaagcaucuauuggacaauaguaaaaccgggagacauacuguugauuaauagcacugggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39066 - RNA, 1701 nt, Artificial Sequence
  hemagglutinin__InfluenzaA__AFG99193
augaagacuaucauugcuuugagcuacauuuccugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaucuuuuuguugaacgcagcaaagcuuucagcaacugcuacccuuaugaugugccggauuaugccucccuuaggucacuaguugccucaucaggcacccuggaguuuaucaaugaaggcuucaauuggacuggagucacucagagugggggaagcuaugcuugcaaaaggggaucuguuaacaguuucuucaguagauugaauugguuguaugagucagaaagcaaauauccagcgcugaacgugacuaugccaaacaauggcaaauuugaaaaauuguacauuugggggguucaccacccuagcacggacaaagaacaaaccaaccuauauguucgagcaucagggagagucacagucucuaccaagagaagccagcaaacuguaaucccgaauaucgggccuagacccuggguaaggggucugucuaguagaauaaguaucuauuggacaauaguaaaaccgggagacauacuguugauuaauagcacugggaaccuaauugcuccccgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaagcaaaacacucugaaguuggcaacagggaugcggaauguaccugagaaacaaacuagaggcauauucggcgcaauagcagguuucauagaaaaugguugggaggggaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugauaugacugacucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucauaaugugggccugccaaaaaggcaacauuaggugcaacauuugcauuuga

SEQ ID NO: 39067 - RNA, 1701 nt, Artificial Sequence
  hemagglutinin__InfluenzaA__AFG99204
augaagacuaucauugcuuugagcuacauuuucugucuggguuucgcccaaaaacuucccggaaaugacaacagcacagcaacgcugugccugggacaccaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcacccuggaguuuaucaaugaaggcuucaauuggacuggagucacucagagugggggaagcuaugcuugcaaaaggggaucuguuaacaguuucuucaguagauugaauugguuauacaaaucagaaagcaaauauccagcgcugaacgugacuaugccaaacaauggcaaauuugacaaauuguacauuugggggguucaccacccgagcacggacaaagaacaaaccaaccuauauguucgagcaucagggagagucacagucucuaccaagagaagccagcaaacuguaaucccgaauaucgggucuagacccuggguaaggggucugucuaguagaauaagcaucuauuggacaauaguaaaaccgggagacauacuguugauuaauagcacuggaaaccuaauugcuccucgggguuacuucaaaauacgcacugggaaaagcucaauaauaaggucagaugcaccuauuggcaccugcaguucugaaugcaucacuccaaauggaagcauucccaaugacaaacccuuucaaaauguaaacaagaucacauauggggcaugucccagguauguuaaacaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugcuugcauaggaucaaucagaaauggaacuuaugaccaugauguauacagagacgaagcauugaacaaccgguuucagaucaaagguguugagcugaagucaggauacaaagacuggauccuauggauuuccuuugccauaucaugcuuuuugcuuuguguuguuuugcugggguuuaucaugugggccugccaaaaaggcaacauuaggugcaacauuugcauuuga

SEQ ID NO: 39068 - RNA, 1701 nt, Artificial Sequence
  hemagglutinin__InfluenzaA__AFG99215
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggauuccaaaaugagaaaugggaccuuuuuauugaacgcagcaaagcuuucagcaacuguuacccuuaugaugugccggauuaugccucccuuaggucacuaguugccucaucaggcacccuggaguuuaucaaugaaggcuucaauuggacuggagucacucagagugggggaagcuaugcuugcaaaaggggaucuguuaacaguuucuucaguagauugaauugguuguacgaaucagaauacaaauauccagcgcugaacgugacuaugccaaacaauggcaaauuugacaaacuguacauuugggggguucaccacccgagcacggaaaaagaacaaaccaaccuauauguucgagcaucagggagagucacagucucuaccaagagaagccagcaaacuguaaccccgaauaucgggucuagacccuggguaaggggucuguccaguagaauaagcaucuauuggacaauaguaaaaccgggagacauacuguugauuaauagcacugggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39069 - RNA, 1701 nt, Artificial Sequence
  hemagglutinin__InfluenzaA__AFG99226
augaagacuaucauugcuuugagcuacauuuucugucugguuuucgcccaaaaacugccuggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuucagcaacuguuacccuuaugaugugccugauuaugccucccuuaggucacuaguugccucaucaggcacccuggaguuuaucaaugaaggcuucaauuggacuggagucacucagagugggggaagcuaugcuugcaaaaggggaucuguuaacaguuucuucaguagauugaauugguuguacgaaucagaauacaaauauccagcgcugaacgugacuaugccaaacaauggcaaauuugacaaauuguacauuugggggguucaccacccgagcacggacaaagaacaaaccaaccuauauguucgagcaucagggagagucacagucucuaccaagagaagccagcaaacuguaaucccgaauaucgggucuagacccuggguaagaggucuguccaguagaauaagcaucuauuggacaauaguaaaaccgggagacauacugucgauuaauagcacugggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaccugacugacucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39070 - RNA, 1701 nt, Artificial Sequence
  hemagglutinin__InfluenzaA__AFG99237
augaagacuaucauugcuuugagcuacauuuucugucugguuuucgcccagaaacugcccggaaaugacaacagcacagcaacgcugugccugggacaucaugcagugccaaacggaacgcuagugaaaacaaucacgaaugaucagauugaagugacuaaugcuacugagcugguucaaaguuccucaacaggucgaauaugcgacaguccucaccgaauccuugauggaaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcacccuggaguuuaucaaugaagacuucaauuggacuggagucacucagagugggggaagcuaugcuugcaaaagggaaucuguuaacaguuucuucaguagauugaauugguuguacgaaucagaauacaaauauccagcgcugaacgugacuaugccaaacaauggcaaauuugaaaaauuguacauuugggggguucaccacccgagcacggacaaagaacaaaccaaccuauauguucgagcaucagggagagucacagucucuaccaagagaagccagcaaacuguaaucccgaauaucgggucuagacccugggugagaggucuguccaguagaauaagcaucuauuggacaauaguaaaaccgggagacauacuguugauuaauagcacugggaaccuaauugcuccucgggguuacuuuaaaauacgcacugggaaaagcucaauaaugaggucagaugcacccauuggcaccugcaguucugaaugcaucacuccaaauggaagcauucccaaugacaaacccuuucaaaauguaaacaagaucacauauggggcaugucccagguauguuaggcaaaacacccugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39071 - RNA, 1701 nt, Artificial Sequence
  hemagglutinin__InfluenzaA__AFG99248
augaagacuaucauugcuuugagcuacauuuucugucugguuuucgcccaaaaacuucccggaaaugacaacagcacagcaacgcugugccugggacaucaugcagugccaaacggaacgcuagugaaaacaauaacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucacucagagugggggaagccaugcuugcaaaaggggaucuguuaacaguuucuucaguagauugaauugguugcacgaaucagaauacaaauauccagcgcugaacgugacuaugccaaacaauggcaaauuugacaaauuguacauuugggggguucaccacccgaucacggacagagaacaaaccaaccuauauguucgagcaucagggagagucacagucucuaccaagagaagccagcaaacuguaaucccgaauaucggguuuagacccuggguaaggggucuguccaguagaauaagcaucuauuggacaauaguaaaaccgggagacauacuguugauuaauagcaccgggaaccuaauugcuccucgggguuacuucaaaauacgcaaugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39072 - RNA, 1701 nt, Artificial Sequence
  hemagglutinin__InfluenzaA__AFG99259
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagguugaagugacuaaugcuacugagcugguucagaguuccucaacagguagaauaugcgacaguccucaccgaauccuugaugggaaaaacugcacgcugauagaugcucuauugggagacccucauugugauggcuuccaaaaugagaaaugggaccuuuuuguugaacgcagcaaagcuuacagcaacuguuacccuuaugauguaccggauuaugcuucccuuaggucacuaguugccucaucaggcacccuggaguuuaucaaugaagacuucaauuggacuggagucacucagagugggggaagcuaugcuugcaaaaggggaucuguuaacaguuucuucaguagauugaauugguugcacaaaucagaauacaaauauccagcgcugaacgugacuaugccaaacaauggcaaauuugacaaauuguacauuugggggguucaccacccgagcacagacagagaacaaaccaaccuauauguucgagcaucagggagagucacagucucuaccaagagaagccagcaaacuguaaucccgaauaucgggucuagacccuggguaaggggccuguccaguagaauaagcaucuauuggacaauaguaaaaccgggagacauacuguugauuaauagcaccgggaaccuaauugcuccucgggguuacuucaaaauacgcacugggaaaagcucaauaaugaggucagaugcaccuauuggcaccugcaguucugaaugcaucacuccaaaugggagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucaucgaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaaugcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39073 - RNA, 1701 nt, Artificial Sequence
  hemagglutinin__InfluenzaA__AFG99270
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagagugggggaagcuaugcuugcaaaaggggaucuguuaacaguuucuuuaguagauugaauugguugcacaaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucuaccaaaagaagccagcaaacuguaaucccgaauaucgggucuagacccuggguaaggggucuguccaguaggauaagcaucuauuggacaauaguaaaaccgggagacauacuguugauuaauagcaccgggaaccuaauugcuccucgggguuacuucaaaauacgaacugggaaaagcucaauaaugaggucagaugcacccauuggcaccugcaguucugaaugcaucacuccaaauggaagcauucccaaugacaaacccuuucaaaauguaaacaggaucacauauggggcaugucccagauauguuaaacaaaacacucugaaauuggcaacagggaugcggaauguaccagagaaacaaacuagaggcauauucggcgcaaucgcagguuucauagaaaaugguugggagggaaugguagacgguugguacgguuucaggcaucauaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39074 - RNA, 1701 nt, Artificial Sequence
  hemagglutinin__InfluenzaA__AFG99281
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcacccuggaguuuaucaaugaagaauucaauuggacuggagucacucagagugggggaagcuaugcuugcaaaaggggaucuguuaacaguuucuucaguagauugaauugguugcacaaaucagaauacaaauauccagcgcugaacgugacuaugccaaacaauggcagauuugacaaauuguacauuugggggguucaccacccuagcacggacagagaacaaaccaaccuauauguucgagcaucagggagagucacagucucuaccaagagaagccagcaaacuguaaucccgaauaucgggccuagacccuggguaaggggucuguccaguagaauaagcaucuauuggacaauaguaaaaccgggggacauacuguugauuaauagcacugggaaccuaauugcuccucgggguuacuucaaaauacacacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaagcaaaacacucuaaaauuggcaacagggaugcggaauguaccagauaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaagaaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggauucaucaugugggccugccaaaaaggcaacauuaggugcaacauuugcauuuga

SEQ ID NO: 39075 - RNA, 1701 nt, Artificial Sequence
  hemagglutinin__InfluenzaA__AFG99292
augaagacuaucauugcuuugagcuacauuuucugucugguuuucgcccaaaaacuuccuggaaaugacaacagcacagcaacgcugugccugggacaucaugcagugccaaacggaacgcuagugaaaacaaucacgaaugaucagguugaagugacuaaugcuacugagcugguucagaguuccucaacagguagaauaugcgacaguccucaccgaauccuugaugggaaaaacugcacgcugauagaugcucuauugggagacccucauugugauggcuuccaaaaugagaaaugggaccuuuuuguugaacgcagcaaagcuuacagcaacuguuacccuuaugauguaccggauuaugcuucccuuaggucacuaguugccucaucaggcacccuggaguuuaucaaugaagacuucaauuggacuggagucacucagagugggggaagcuaugcuugcaaaaggggaucuguuaacaguuucuucaguagauugaauugguugcacgaaucagaauacaaauauccagcgcugaacgugacuaugccaaacaauggcaaauuugacaaauuguacauuugggggguucaccacccgagcacagacagagaacaaaccaaccuauauguucgagcaucagggagagucacagucucuaccaagagaagccagcaaacuguaaucccgaauaucgggucuagacccuggguaaggggccuguccaguagaauaagcaucuauuggacaauaguaaaaccgggagacauacuguugauuaauagcaccgggaaccuaauugcuccucgggguuacuucaaaauacgcacugggaaaagcucaauaaugaggucagaugcaccuauuggcaccugcaguucugaaugcaucacuccaaaugggagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucaucgaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaaugcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39076 - RNA, 1701 nt, Artificial Sequence
  hemagglutinin__InfluenzaA__AFG99303
augaagaccaucauugcuuugagcuacauuuucugucugguugucgcccaaaaacuucccggaaaugacaacagcacagcaacgcugugccugggacaucaugcagugccaaacggaacgcuagugaaaacaaucacgaaugaccaaauugaagugacuaaugcuacugagcugguucagaguuccucaacaggucgaauaugcgacaguccucaccgaauccuugauggaaaaaacugcacacugauagaugcucuauugggagauccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagagugggggaagcuaugcuugcaaaaggggaucuguuaacaguuucuucaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucuccaccaaaagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgaacuggaaaaagcucaauaaugaggucagaugcacccauuggcaccugcaguucugaaugcaucacuccaaauggaagcauuuccaaugacaaacccuuucaaaauguaaacaggaucacauauggggcaugucccagauauguuaagcaaaacacucugaaauuggcaacagggaugcggaaugugccagaaaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacggaaaacugaauagguuaaucgagaaaacgaacgagaaauuccaucaaaucgaaaaggaauucucagaaguagaagggagaauucaggaccucgagaaauauguugaagacacuaaaauagaucuuuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39077 - RNA, 1701 nt, Artificial Sequence
  hemagglutinin__InfluenzaA__AFG99314
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauaguuuccaaaaugagaaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucacucagagugggggaagcuaugcuugcaaaaggggaucuguuaacaguuucuucaguagauugaauugguuacacgaaucagaauacaaauauccagcgcugaacgugacuaugccaaacaauggcaaauuugacaaauuguacauuugggggauccaccacccgagcacggacagagaacaaaccaaccuauauguucgagcaucagggagagucacagucucuaccaagagaagccagcaaacuguaaucccgaauaucgggucuagacccuggguaaggggucuauccaguagaauaagcaucuauuggacaauaguaaaaccgggagacauacuguugauuaauagcaccgggaaccuaauugcuccucgggguuacuucaaauuacgcacugggaaaagcucaauaaugaggucagaugcaccuauuggcaccugcaguucugaaugcaucacuccaaauggaagcauucccaaugacaaaccauuucaaaauguaaacaagaucaccuauggggcaugucccagguauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacggaaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39078 - RNA, 1701 nt, Artificial Sequence
  hemagglutinin__InfluenzaA__AFG99336
augaagaccaucauugcuuugagcuacauuuucugucugguuuucgcccaaaaacuucccggaaaugacaacagcacagcaacgcugugccuaggacaucaugcagugccaaacggaacgcuagugaaaacaaucacgaaugaccaaauugaagugacuaaugcuacugagcugguucagaguuccucaacaggucgaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucccuaguugccucaucaggcacccuggaguuuaucaaugaagacuucaauuggacuggagucgcucagagugggggaagcuaugcuugcaaaaggggaucuguuaacaguuucuucaguagauugaauugguugcacaaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucuaccaaaagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgaacuggaaaaagcucaauaaugaggucagaugcacccauuggcaccugcaguucugaaugcaucacuccaaauggaagcauucccaaugacaaacccuuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcucuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39079 - RNA, 1701 nt, Artificial Sequence
  hemagglutinin__InfluenzaA__AFG99347
augaagaccaucauugcuuugagcuacauuuucugucugguuuucgcccaaaaacuucccggaaaugacaacagcacagcaacgcugugccuaggacaucaugcagugccaaacggaacgcuagugaaaacaaucacgaaugaccaaauugaagugacuaaugcuacugagcugguucagaguuccucaacaggucgaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucccuaguugccucaucaggcacccuggaguuuaucaaugaagacuucaauuggacuggagucgcucagagugggggaagcuaugcuugcaaaaggggaucuguuaacaguuucuucaguagauugaauugguugcacaaaccagaauacaaauauccagcgcugaacgugacuaugccaaacaauggcaaauuugacaaauuguacauuugggggguucaccacccgagcacggacagagaacaaaccaaccuauauguucgagcaucagggagagucacagucucuaccaaaagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgaacuggaaaaagcucaauaaugaggucagaugcacccauuggcaccugcaguucugaaugcaucacuccaaauggaagcauucccaaugacaaacccuuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgauaaaacgaacgagaaauuccaucaaaucgaaaaggaauucucagaaguagaagggagaauucaggaccucgagaaauauguugaagacacuaaaauagaucucuggucuuacaacgcggagcuucuugucgcucuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuagaugcaacauuugcauuuga

SEQ ID NO: 39080 - RNA, 1701 nt, Artificial Sequence
  hemagglutinin__InfluenzaA__AFG99358
augaagacuaucauugcuuugagccacauuuuaugucugguuuucgcucaaaaacuucccggaaaugacaacagcacagcaacgcuaugccugggacaucaugcagugccaaacggaacgcuagugaaaacaaucacgaaugaucaaauugaagugacuaaugcuacugaguugguucagaguucuucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaauuuaucaaugaagacuucaauuggacuggagucgcucaggaugggggaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaccccgaauaucgggucuagacccuggguaaggggucuguccaguagaauaagcaucuauuggacaauaguaaaaccgggagacauacuuuugauuaauagcauagggaaucuaauugcuccucgggguuacuucaaaauacgaaaugggaaaagcucaauaaugaggucagauguacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguaugguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguggaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39081 - RNA, 1701 nt, Artificial Sequence
  hemagglutinin__InfluenzaA__AFG99369
augaagacuaucauugcuuugagcuacauuuucugucugguuuucgcccaaaaacuucccggaaaugacaacagcacagcaacgcugugccugggacaucaugcagugccaaacggaacacuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuucaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauugggcuggagucgcucagagugggggaagcuaugcuugcaaaaggggaucuguuaacaguuucuuuaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucaaccaaaagaagccagcaaacuguaaucccgaauaucgggucuagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucaauaaugaggucagaugcacccauuggcaccugcaguucugaaugcaucacuccaaauggaagcauucccaaugacaaacccuuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccacaucaugcuuuuugcuuuguguuguuuugcugggguucaucaugugggccugccaaaaaggcaacauuaggugcaacauuugcauuuga

SEQ ID NO: 39082 - RNA, 1701 nt, Artificial Sequence
  hemagglutinin__InfluenzaA__AFG99380
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuucaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagagugggggaagcuaugcuugcaaaaggggaucuguuaacaguuucuuuaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucaaccaaaagaagccagcaaacuguaaucccgaauaucgggucuagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucaauaaugaggucagaugcacccauuggcaccugcaguucugaaugcaucacuccaaauggaagcauucccaaugacaaacccuuucaaaauguaaacaggaucacauauggggcaugucccagauauguuaagcaaaacacucugaaauuggcaacagggaugcggaauguaccagagaaacaaacuagaggcauauucggagcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcagcugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggguacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39083 - RNA, 1701 nt, Artificial Sequence
  hemagglutinin__InfluenzaA__AFG99391
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuucaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagagugggggaagcuaugcuugcaaaaggggaucuguuaacaguuucuuuaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucaaccaaaagaagccagcaaacuguaaucccgaauaucgggucuagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucaauaaugaggucagaugcacccauuggcaccugcaguucugaaugcaucacuccaaauggaagcauucccaaugacaaacccuuucaaaauguaaacaggaucacauauggggcaugucccagauauguuaagcaaaacacucugaaauuggcaacagggaugcggaauguaccagagaaacaaacuagaggcauauucggagcaaucgcagguuucauagaaaaugguugggagggaaugguagacgguugguacggcuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcagcugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggguacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39084 - RNA, 1701 nt, Artificial Sequence
  hemagglutinin__InfluenzaA__AFG99402
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucacucagagugggggaagcuaugcuugcaaaaggggaucuguuaacaguuucuucaguagauugaauugguugcacaaaucagaauacaaauauccagcgcugaacgugacuaugccaaacaauggcaaauuugacaaauuguacauuugggggguucaccacccggucacggacagagaacaaaccaaccuauauguucgagcaucagggagagucacagucucuaccaagagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagauauguuaagcaaaacacucugaaauuggcaacagggaugcggaauguaccagagaaacaaacuagaggcauauucggcgcaauagcagguuucauagaaaaugguugggagggaaugguagacggcugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39085 - RNA, 1701 nt, Artificial Sequence
  hemagglutinin__InfluenzaA__AFG99413
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuucaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagagugggggaagcuaugcuugcaaaaggggaucuguuaacaguuucuuuaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucaaccaaaagaagccagcaaacuguaaucccgaauaucgggucuagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucaauaaugaggucagaugcacccauuggcaccugcaguucugaaugcaucacuccaaauggaagcauucccaaugacaaacccuuucaaaauguaaacaggaucacauauggggcaugucccagauauguuaagcaaaacacucugaaauuggcaacagggaugcggaauguaccagagaaacaaacuagaggcauauucggagcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaggcagcugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggguacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39086 - RNA, 1701 nt, Artificial Sequence
  hemagglutinin__InfluenzaA__AFG99424
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuucaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagagugggggaagcuaugcuugcaaaaggggaucuguuaacaguuucuuuaguagauugaauugguugcacaaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucaaccaaaagaagccagcaaacuguaaucccgaauaucgggucuagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucaauaaugaggucagaugcacccauuggcaccugcaguucugaaugcaucacuccaaauggaagcauucccaaugacaaacccuuucaaaauguaaacaggaucacauauggggcaugucccagauauguuaagcaaaacacucugaaauuggcaacagggaugcggaauguaccagagaaacaaacuagaggcauauucggagcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaggcagcugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggguacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39087 - RNA, 1701 nt, Artificial Sequence
  hemagglutinin__InfluenzaA__AFG99435
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugaguugguucagaauuccucaacagguagaauaugcgacaguccucaccgaauccuugacggaaaaaacugcacacugauagaugcucuauugggagacccucauugugauggccuccaaaauaaggaaugggaccuuuuuguugaacgcagcaaagcuuacagcaacuguuacccuuaugaugugccggauuaugccucccuuaggucacuaguugccucaucaggcacucuggaguuuaccaaggaagacuucaauuggacuggagucgcucagagugggggaagcuaugcuugcaaaaggggaucuguuaacaguuucuucaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucuaccaaaagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgaacuggaaaaagcucaauaaugaggucagaugcacccauuggcaccugcaguucugaaugcaucaccccaaauggaagcauucccaaugacaaacccuuucaaaauguaaacaggaucacauauggggcaugucccagauauguuaagcaaaacacucugaaauuggcaacagggaugcggaauguaccagagaaacaaacuaggggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaauagaaaaggaauucucagaaguagaagggagaauucaggaccucgagaaauauguugaagacacuaaaauagaucucuggucuuacaacgcggagcuucuugucgcccuggagaaccaacauacaauugaccugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39088 - RNA, 1701 nt, Artificial Sequence
  hemagglutinin__InfluenzaA__AFG99446
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugaguugguucagaauuccucaacagguagaauaugcgacaguccucaccgaauccuugacggaaaaaacugcacacugauagaugcucuauugggagacccucauugugauggccuccaaaauaaggaaugggaccuuuuuguugaacgcagcaaagcuuacagcaacuguuacccuuaugaugugccggauuaugccucccuuaggucacuaguugccucaucaggcacucuggaguuuaccaaggaagacuucaauuggacuggagucgcucagagugggggaagcuaugcuugcaaaaggggaucuguuaacaguuucuucaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucuaccaaaagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgaacuggaaaaagcucaauaaugaggucagaugcacccauuggcaccugcaguucugaaugcaucaccccaaauggaagcauucccaaugacaaacccuuucaaaauguaaacaggaucacauauggggcaugucccagauauguuaagcaaaacacucugaaauuggcaacagggaugcggaauguaccagagaaacaaacuaggggcauauucggcgcaaucgcagguuucauagaaaaugguugggagggaaugguagaugguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaauagaaaaggaauucucagaaguagaagggagaauucaggaccucgagaaauauguugaagacacuaaaauagaucucuggucuuacaacgcggagcuucuugucgcccuggagaaccaacauacaauugaccugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaaccuaugaccaugauguauacagagacgaagcauuaaacaaccgguuccagaucaaagguguugagcugaagucaggauacaaagacuggauccuauggauuucuuuugccauaucaugcuuuuugcuuuguguuguuuugcugggguucaucaugugggccugccaaaaaggcaacauuaggugcaacauuugcauuuga

SEQ ID NO: 39089 - RNA, 1701 nt, Artificial Sequence
  hemagglutinin__InfluenzaA__AFG99457
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauucuugauggggaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagagugggggaagcuaugcuugcaaaaggggaucuguuaacaguuucuuuaguagauugaauugguugcacaaaucagaauacaaauauccagcgcugaacgugacuaugccaaacaauggcaaauuugacaaauuguacauuugggggguucaccacccgagcacggacagagaccaaaccagccuauauguucgagcaucagggagagucacagucucuaccaaaagaagccaacaaacuguaaucccgaauaucgggucuagacccuggguaaggggucaguccaguagaauaagcaucuauuggacaauaguaaaaccgggagacauacuuuugauuaauagcaccgggaaccuaauugcuccucgggguuacuucaaaauacgaaaugggaaaagcucaauaaugaggucagaugcacccauuggcaccugcaguucugaaugcaucacuccaaauggaagcauucccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39090 - RNA, 1701 nt, Artificial Sequence
  hemagglutinin__InfluenzaA__AFG99468
augaagaccaucauugcuuugagcuacauuuucugucugguuuucgcccaaaaacuucccggaaaugacaacagcacagcaacgcugugccuaggacaucaugcagugccaaacggaacgcuagugaaaacaaucacgaaugaccaaauugaagugacuaaugcuacugagcugguucagaguuccucaacaggucgaauaugcgacaguccucaccggauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagagugggggaagcuaugcuugcaaaaggggaucuguuaacaguuucuucaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucuaccaaaagaagccagcaaacuguaaucccgaauaucgggucuagacccuggguaaggggucuguccaguagaauaagcaucuauuggacaauaguaaaaccgggagacauacuguugauuaauagcacugggaaccuaauugcuccucggggcuacuucaaaauacgaacuggaaaaagcucaauaaugaggucagaugcacccauuggcaccugcaguucugaaugcaucacuccaaauggaagcauucccaaugacaaacccuuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaauggacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39091 - RNA, 1701 nt, Artificial Sequence
  hemagglutinin__InfluenzaA__AFG99490
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuauugaacgcagcaaagcuuacagcaacuguuacccuuaugaugugccggauuaugccucccuuaggucacuaguugccucaucaggcacccuggaguuuaucaaugaagacuucaauuggacuggagucgcucagaguggggaaagcuaugcuugcaaaaggggaucuguuaaaaguuucuuuaguagauugaauugguugcacgaaucagaauacaaauauccagcgcugaacgugacuaugccaaacaauggcaaauuugacaaauuguacauuugggggguucaccacccgagcacggacagagaacaaaccagccuauauguucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39092 - RNA, 1701 nt, Artificial Sequence
  hemagglutinin__InfluenzaA__AFG99501
augaagaccaucauugcuuugagcuacauuuucugucugguugucgcccaaaaacuucccggaaaugacaacagcacagcaacgcugugccugggacaucaugcagugccaaacggaacgcuagugaaaacaaucacgaaugaccaaauugaagugacuaaugcuacugagcugguucagaguuccucaacaggucgaauaugcgacaguccucaccgaauccuugauggaaaaaacugcacacugauagaugcucuauugggagauccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagagugggggaagcuauacuugcaaaaggggaucuguuaacaguuucuucaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucuccaccaaaagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgaacuggaaaaagcucaauaaugaggucagaugcacccauuggcaccugcaguucugaaugcaucacuccaaauggaagcauuuccaaugacaaacccuuucaaaauguaaacaggaucacauauggggcaugucccagauauguuaagcaaaacacucugaaauuggcaacagggaugcggaaugugccagaaaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacggaaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39093 - RNA, 1701 nt, Artificial Sequence
  hemagglutinin__InfluenzaA__AFG99512
augaagacuaucauugcuuugagcuacauuuuaugucugguuuucgcccaaaaacuucccggaaaugacaacagcacagcaacgcugugccuggggcaucaugcagugccaaacggaacucuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccagauuaugccucccuuaggucacuaguugccucaucaggcacccuggaguuuaucaaugaagacuucaauuggacuggagucgcucagaguggggacagcuaugcuugcaaaaggggaucuguuaaaaguuucuuuaguagauugaauugguugcacgaaucagaauacaaauauccagcgcugaacgugacuaugccaaacaaugacaaauuugacaaguuguacauuugggggguucaccacccgagcacggacagagaacaaaccagccuauauauucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaucuaauugcuccucgggguuacuucaaaauacgaacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugagaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39094 - RNA, 1701 nt, Artificial Sequence
  hemagglutinin__InfluenzaA__AFG99523
augaagaccaucauugcuuugagcuacauuuucugucugguuuucgcccaaaaacuucccggaaaugacaacagcacagcaacgcugugccuaggacaucaugcagugccaaacggaacgcuagugaaaacaaucacgaaugaccaaauugaagugacuaaugcuacugagcugguucagaguuccucaacaggucgaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugauguaccggauuaugccucccuuaggucacuaguugccucaucaggcacccuggaguuuaucaaugaagacuucaauuggacuggagucgcucagagugggggaagcuaugcuugcaaaaggggaucuguuaacaguuucuucaguagauugaauugguugcacgaaucacaauacaaauauccagcacugaacgugacuaugccaaacaauggcaaauuugacaaauuguacaucugggggguucaccacccgagcacggacagagaacaaaccaaccuauauguucgagcaucagggagagucacagucucuaccaaaagaagccagcaaacuguaaucccgaacaucgggucuagacccuggguaaggggucuguccaguagaauaagcaucuauuggacaauaguaaaaccgggagacauacuguugauuaauagcaccggaaaccuaauugcuccucgggguuacuucaaaauacgaacugggaaaagcucaauaaugaggucagaugcacccauuggcaccugcaguucugaaugcaucacuccaaauggaagcauucccaaugacaaacccuuucaaaauguaaacagaaucacauauggggcaugucccagauauguuaagcaaaacacucugaaauuggcaacagggaugcggaauguaccagagaaacaaacuagaggcauauucggugcaaucgcaggcuucauagaaaaugguugggaggggaugguagacgguugguacgguuucaggcaucaaaauucugagggcacaggacaagcagcagaucuuaaaagcacucaagcagcaaucgaccaaaucaacgggaaacugaauagguuaaucgaaaaaacgaacgagaaauuccaucaaaucgaaaaggaauucucagaaguagaagggagaauucaggaccucgagaaauauguugaagacacuaaaauagaucucuggucuuacaacgcggagcuucuugucgcucuggagaaccaacacacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39095 - RNA, 1701 nt, Artificial Sequence
  hemagglutinin__InfluenzaA__AFG99534
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccaggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaaccuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39096 - RNA, 1701 nt, Artificial Sequence; identical to SEQ ID NO: 38991
  hemagglutinin__InfluenzaA__AFG99545

SEQ ID NO: 39097 - RNA, 1701 nt, Artificial Sequence
  hemagglutinin__InfluenzaA__AFG99556
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccaggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucguaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaaccuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39098 - RNA, 1701 nt, Artificial Sequence; identical to SEQ ID NO: 38991
  hemagglutinin__InfluenzaA__AFG99567

SEQ ID NO: 39099 - RNA, 1701 nt, Artificial Sequence
  hemagglutinin__InfluenzaA__AFG99578
augaagacuaucauugcuuugagcuacauuuuaugucugguuuucgcccaaaaacuucccggaaaugacaacagcacagcaacgcugugccugggacaucaugcagugccaaacggaacguuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39100 - RNA, 1701 nt, Artificial Sequence; identical to SEQ ID NO: 38991
  hemagglutinin__InfluenzaA__AFG99589

SEQ ID NO: 39101 - RNA, 1701 nt, Artificial Sequence
  hemagglutinin__InfluenzaA__AFG99600
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaguccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaauugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39102 - RNA, 1701 nt, Artificial Sequence; identical to SEQ ID NO: 38991
  hemagglutinin__InfluenzaA__AFG99611

SEQ ID NO: 39103 - RNA, 1701 nt, Artificial Sequence; identical to SEQ ID NO: 38991
  hemagglutinin__InfluenzaA__AFG99622

SEQ ID NO: 39104 - RNA, 1701 nt, Artificial Sequence; identical to SEQ ID NO: 38991
  hemagglutinin__InfluenzaA__AFG99633

SEQ ID NO: 39105 - RNA, 1701 nt, Artificial Sequence
  hemagglutinin__InfluenzaA__AFG99644
augaagacuaucauugcuuugagcuacauuuuaugucugguuuucgcccaaaaacuucccggaaaugacaacagcacagcaacgcugugccuggggcaucaugcagugccaaacggaacgcuaguaaaaacaaucacgaaugaucaaauugaagugacuaaugcuacugagcugguucagaauuccucaacagguagaauaugcgacaguccucaccgaauccuugauggaaaaaacugcacacugauagaugcucuauugggagacccucauugugaugacuuccaaaauaaggaaugggaccuuuuuguugaacgcagcaaagcuuacagcaacuguuacccuuaugaugugccggauuaugccucccuuaggucacuaguugccgcaucaggcacccuggaguuuaucaaugaagacuucaauuggacuggagucgcucagaguggggaaagcuaugcuugcaaaaggggaucuguuaaaaguuucuuuaguagauugaauugguugcacgaaucagaauacaaauauccagcgcugaacgugaccaugccaaacaauggcaaauuugacaaauuguacauuugggggguucaccacccgagcacggacagagaacaaaccagccuauauguucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagagguauauucggcgcaauugcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaauagaagggagaauucagaaccucgagaaauauguugaagacacuaaaauagaucucuggucuuacaacgcggagcuucuuguugcccuagagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39106 - RNA, 1701 nt, Artificial Sequence
  hemagglutinin__InfluenzaA__AFG99655
augaagacuaucauugcuuugagcuacauuuuaugucugguuuucgcccaaaaacuucccggaaaugacaacagcacagcaacgcugugccuggggcaucaugcagugccaaacggaacgcuaguaaaaacaaucacgaaugaucaaauugaagugacuaaugcuacugagcugguucagaauuccucaacagguagaauaugcgacaguccucaccgaauccuugauggaaaaaacugcacacugauagaugcucuauugggagacccucauugugaugacuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagaguggggaaagcuaugcuugcaaaaggggaucuguuaaaaguuucuuuaguagauugaauugguugcacgaaucagaauacaaauauccagcgcugaacgugaccaugccaaacaauggcaaauuugacaaauuguacauuugggggguucaccacccgagcacggacagagaacaaaccagccuauauguucgagcaucagggagagucacagucucuaccaaaagaagccaacaaacuguaaucccgaauaucggguccagacccuggguaaggggacuguccaguagaauaagcaucuauuggacaauaguaaaaccgggagacauacuuuugauuaauagcaccgggaaccuaauugcuccucgggguuacuucaaaauacgaacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagagguauauucggcgcaauugcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaauagaagggagaauucaggaccucgagaaauauguugaagacacuaaaauagaucucuggucuuacaacgcggagcuucuuguugcccuagagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagauaaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39107 - RNA, 1701 nt, Artificial Sequence
  hemagglutinin__InfluenzaA__AFG99666
augaagacuaucauugcuuugagcuacauuuuaugucugguuuucgcccaaaaacuucccggaaaugacaacagcacagcaacgcugugccuggggcaucaugcagugccaaacggaacgcuaguaaaaacaaucacgaaugaucaaauugaagugacuaaugcuacugagcugguucagaauuccucaacagguagaauaugcgacaguccucaccgaauccuugauggaaaaaacugcacacugauagaugcucuauugggagacccucauugugaugacuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagaguggggaaagcuaugcuugcaaaaggggaucuguuaaaaguuucuuuaguagauugaauugguugcacgaaucagaauacaaauauccagcgcugaacgugaccaugccaaacaauggcaaauuugacaaauuguacauuugggggguucaccacccgagcacggacagagaacaaaccagccuauauguucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagagguauauucggcgcaauugcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaauagaagggagaauucaggaccucgagaaauauguugaagacacuaaaauagaucucuggucuuacaacgcggagcuucuuguugcccuagagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagauaaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39108 - RNA, 1701 nt, Artificial Sequence; identical to SEQ ID NO: 32842
  hemagglutinin__InfluenzaA__AFG99677

SEQ ID NO: 39109 - RNA, 1701 nt, Artificial Sequence; identical to SEQ ID NO: 38991
  hemagglutinin__InfluenzaA__AFG99688

SEQ ID NO: 39110 - RNA, 1701 nt, Artificial Sequence
  hemagglutinin__InfluenzaA__AFG99701
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaacgcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaaccuaugaccaugauguauacagagacgaagcauuaaacaaccgguuccagaucaaaggugcugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39111 - RNA, 1701 nt, Artificial Sequence
  hemagglutinin__InfluenzaA__AFG99712
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaagugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaaccuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39112 - RNA, 1701 nt, Artificial Sequence; identical to SEQ ID NO: 38993
  hemagglutinin__InfluenzaA__AFG99723

SEQ ID NO: 39113 - RNA, 1701 nt, Artificial Sequence; identical to SEQ ID NO: 39107
  hemagglutinin__InfluenzaA__AFG99734

SEQ ID NO: 39114 - RNA, 1701 nt, Artificial Sequence
  hemagglutinin__InfluenzaA__AFG99745
augaagacuaucauugcuuugagcuacauuuuaugucugguuuucgcccaaaaacuucccggaaaugacaacagcacagcaacgcugugccuggggcaucaugcagugccaaacggaacucuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccagauuaugccucccuuaggucacuaguugccucaucaggcacccuggaguuuaucaaugaagacuucaauuggacuggagucgcucagaguggggacagcuaugcuugcaaaaggggaucuguuaaaaguuucuuuaguagauugaauugguugcacgaaucagaauacaaauauccagcgcugaacgugacuaugccaaacaaugacaaauuugacaaguuguacauuugggggguucaccacccgagcacggaaagagaacaaaccagccuauauauucgagcaucagggagagucacagucucuaccaaaagaagccaacaaacuguaaucccgaauaucggguccaaacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugagaaaacaaggaagcaacugagggaaaaugcugaggacaugggcaaugguugcuucaaaauauaccacaaaugugacaaugccugcauggggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39115 - RNA, 1701 nt, Artificial Sequence; identical to SEQ ID NO: 38993
  hemagglutinin__InfluenzaA__AFG99756

SEQ ID NO: 39116 - RNA, 1701 nt, Artificial Sequence
  hemagglutinin__InfluenzaA__AFG99767
augaagacuaucauugcuuugagcuacaucuuaugucugguuuucgcccaaaaacuucccggaaaugacaacagcacagcaacgcugugccuggggcaucaugcagugccaaacggaacucuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugaugacuuccaaaauaaggaaugggaccuuuuuguugaacgcagcaaagcuuacagcaacuguuacccuuaugaugugccagauuaugccucccuuaggucacuaguugccucaucaggcacccuggaauuuaucaaugaagacuucaauuggacuggagucgcucagaguggggaaagcuaugcuugcaaaaggggaucuguuaaaaguuucuuuaguagauugaauugguugcacgaaucagaauacaaauauccagcgcugaacgugacuaugccaaacaaugacaaauuugacaaauuguacauuugggggguucaccacccgagcacggacagagaacaaaccagccuauauauucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaccuaauugcuccuagggguuacuucaaaauacgaacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaauagagaaaacgaacgagaaauuccaucaaaucgaaaaggaauucucagaaguagaagggagaauucaggaucucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39117 - RNA, 1701 nt, Artificial Sequence
  hemagglutinin__InfluenzaA__AFG99778
augaagaccaucauugcuuugagcuacauuuuaugucugguuuucgcucaaaaacuucccggaaaugacaacagcacagcaacgcuaugccugggacaucaugcagugccaaacggaacgcuagugaaaacacucacgaaugaucaaauugaagugacuaaugcuacugagcugguucagaguuccucaacagguaaaauaugcgacaguccucaccgaauccuugauggaaaaaacugcacacugauagaugcucuauugggagacccucauugugauggccuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcaaaaggggaucuguuaacaguuucuuuaguagauugaauugguugcacaaaucagaauacaaauauccagcgcugaacgugacuaugccaaacaauggcaaaguugacaaauuguacauuugggggguucaccacccgagcacggacagagaccaaaccagccuauauguucgagcaucagggagagucacagucucuaccaaaagaagccaacaaacuguaaucccgaauaucgggucuagacccuggguaaggggucaguccaguagaauaagcaucuauuggacaauaguaaaaccgggagacauacuuuugauuaauagcaccgggaaccuaauugcuccucgggguuacuucaaaauacgaaaugggaaaagcucaauaaugaggucagaugcacccauuggcaccugcaguucugaaugcaucacuccaaauggaagcauucccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguucugcugggguucaucaugugggccugccaaaaaggcaacauuaggugcaacauuugcauuuaa

SEQ ID NO: 39118 - RNA, 1701 nt, Artificial Sequence
  hemagglutinin__InfluenzaA__AFG99789
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggugcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaaccuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39119 - RNA, 1701 nt, Artificial Sequence
  hemagglutinin__InfluenzaA__AFG99800
augaagacuaucauugcuuugagcuacauuuuaugucugguuuucgcacaaaaacuucccggaaaugacaacagcacagcaacgcugugccuggggcaucaugcagugccaaacggaacgcuaguaaaaacaaucacgaaugaucaaauugaagugacuaaugcuacugagcugguucagaauuccucaacagguagaauaugcgacaguccucaccgaauccuugauggaaaaaacugcacacugauagaugcucuauugggagacccucauugugaugacuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagaguggggaaagcuaugcuuguaaaaggggaucuguuaaaaguuucuuuaguagauugaauugguugcacgaaucagaauacaaauauccagcgcugaacgugaccaugccaaacaauggcaaauuugacaaauuguacauuugggggguucaccacccgagcacggacagagaacaaaccagccuauauguucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauaugugaagcaaaacacucugaaauuggcaacagggaugcggaauguaccagagaaacaaacuagagguauauucggcgcaauugcagguuucauagaaaaugguugggagggaaugguagacgguugguacgguuucaggcaucaaaauucugagggcacaggacaagcagcagaucuuaaaagcacccaagcagcaaucgaccaaaucaacgggaaacugaauagguuaaucgagaaaacgaacgagaaauuccaucaaaucgaaaaggaauucucagaaauagaagggagaauucaggaccucgagaaauauguugaagacacuaaaauagaucucuggucuuacaacgcggagcuucuuguugcccuagagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagauaaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39120 - RNA, 1701 nt, Artificial Sequence
  hemagglutinin__InfluenzaA__AFG99811
augaagacuaucauugcuuugagcuacauuuuaugucugguuuucucccaaaaacuucccggaaaugacaacagcacagcaacgcugugccuggggcaucaugcagugccaaacggaacgcuaguaaaaacaaucacgaaugaucaaauugaagugacuaaugcuacugagcugguucagaauuccucaacagguagaauaugcgacaguccucaccgaauccuugauggaaaaaacugcacacugauagaugcucuauugggagacccucauugugaugacuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagaguggggaaagcuaugcuugcaaaaggggaucuguuaaaaguuucuuuaguagauugaauugguugcacgaaucagaauacaaauauccagcgcugaacgugaccaugccaaacaauggcaaauuugacaaauuguacauuugggggguucaccacccgagcacggacagagaacaaaccagccuauauguucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagagguauauucggcgcaauugcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaauagaagggagaauucaggaccucgagaaauauguugaagacacuaaaauagaucucuggucuuacaacgcggagcuucuuguugcccuagagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39121 - RNA, 1701 nt, Artificial Sequence
  hemagglutinin__InfluenzaA__AFG99822
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaacucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaaccuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39122 - RNA, 1701 nt, Artificial Sequence; identical to SEQ ID NO: 39121
  hemagglutinin__InfluenzaA__AFG99833

SEQ ID NO: 39123 - RNA, 1701 nt, Artificial Sequence
  hemagglutinin__InfluenzaA__AFG99844
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaacucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcagcugagggaaaaugcugaggacaugggcaaugguugcuucaaaauauaccacaaaugugacaaugccugcauagggucaaucagaaauggaaccuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39124 - RNA, 1701 nt, Artificial Sequence
  hemagglutinin__InfluenzaA__AFG99855
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagggaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaaccuaugaccaugacguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39125 - RNA, 1701 nt, Artificial Sequence; identical to SEQ ID NO: 39121
  hemagglutinin__InfluenzaA__AFG99866

SEQ ID NO: 39126 - RNA, 1701 nt, Artificial Sequence; identical to SEQ ID NO: 39121
  hemagglutinin__InfluenzaA__AFG99877

SEQ ID NO: 39127 - RNA, 1701 nt, Artificial Sequence
  hemagglutinin__InfluenzaA__AFG99888
augaagacuaucauugcuuugagcuacauuuuaugucugguuuucgcccaaaaacuucccggaaaugacaacagcacagcaacgcugugccuggggcaucaugcagugccaaacggaacucuagugaaaacaaucacgaaugaucaaauugaagugacuaaugccacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccagauuaugccucccuuaggucacuaguugccucaucaggcacccuggaguuuaucaaugaagacuucaauuggacuggagucgcucagaguggggaaagcuaugcuugcaaaaggggaucuguuaaaaguuucuuuaguagauugaauugguugcacgaaucagaauacaaauauccagcgcugaacgugacuaugccaaacaaugacaaauuugacaaauuguacauuugggggguucaccacccgagcacggacagagaacaaaccagccuauauauucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucgauaaugaggucagaugcacccauuggcaccugcaauucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccuagagaaauauguugaagacacuaaaauagaucucuggucuuacaaugcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuauaaccaugauguauacagagacgaagcauuaaacaaccgguuccagaucaaagguguugagcugaagucaggauacaaagauuggauccuauggauuuccuuugccauaucaugcuuuuugcuuuguguuguucugcugggguucaucaugugggccugccaaaaaggcaacauuaggugcaacauuugcauuuga

SEQ ID NO: 39128 - RNA, 1701 nt, Artificial Sequence; identical to SEQ ID NO: 39121
  hemagglutinin__InfluenzaA__AFG99899

SEQ ID NO: 39129 - RNA, 1701 nt, Artificial Sequence; identical to SEQ ID NO: 38991
  hemagglutinin__InfluenzaA__AFG99910

SEQ ID NO: 39130 - RNA, 1701 nt, Artificial Sequence; identical to SEQ ID NO: 39121
  hemagglutinin__InfluenzaA__AFG99921

SEQ ID NO: 39131 - RNA, 1701 nt, Artificial Sequence
  hemagglutinin__InfluenzaA__AFG99932
augaagaccaucauugcuuugagcuacauuuuaugucugguuuucgcccaaaaacuucccggaaaugacaacagcacagcaacguugugccuggggcaucaugcagugccaaacggaacucuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccagauuaugccucccuuaggucacuaguugccucaucaggcacccuggaguuuaucaaugaagacuucaauuggacuggagucgcucagaguggggaaagcuaugcuugcaaaaggggaucuguuaaaaguuucuuuaguagauugaauugguugcacgaaucagaauacaaauauccagcgcugaacgugacuaugccaaacaaugacaaauuugacaaauuguacauuugggggguucaccacccgagcacggacagagaacaaaccagccuauauauucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaccuaauugcuccucgggguuacuucaaaauacgaacuggaaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39132 - RNA, 1701 nt, Artificial Sequence
  hemagglutinin__InfluenzaA__AFG99943
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucucaaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaacucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaaccuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39133 - RNA, 1701 nt, Artificial Sequence
  hemagglutinin__InfluenzaA__AFG99954
augaagacuaucauugcuuugagcuacauuuuaugucugguuuucgcccaaaaacuucccggaaaugacaacagcacagcaacgcugugccuggggcaucaugcagugccaaacggaacucuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccagauuaugccucccuuaggucacuaguugccucaucaggcacccuggaguuuaucaaugaagacuucaauuggacuggagucgcucagaguggggacagcuaugcuugcaaaaggggaucuguuaaaaguuucuuuaguagauugaauugguugcacgaaucagaauacaaauauccagcgcugaaugugacuaugccaaacaaugacaaauuugacaaguuguacauuugggggguucaccacccgagcacggaaagagaacaaaccagccuauauauucgagcaucagggagagucacagucucuaccaaaagaagccaacaaacuguaaucccgaauaucggguucaaacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugagaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39134 - RNA, 1701 nt, Artificial Sequence
  hemagglutinin__InfluenzaA__AFG99965
augaagaccaucauugcucugagcuacauucuaugucuggcuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacaggaaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauccaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39135 - RNA, 1701 nt, Artificial Sequence
  hemagglutinin__InfluenzaA__AFG99976
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugaugggaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaguuguacauuugggggguucaccacccgagcacggacagagaacaaaccagccuauauguucgagcaucagggagagucacagucuccaccaaaagaagccaacaaacugugaucccgaauaucggauccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaacccuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaaccuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39136 - RNA, 1701 nt, Artificial Sequence
  hemagglutinin__InfluenzaA__AFG99987
augaagacuaucauugcuuugagcuacauuuuaugucugguuuucgcccaaaaacuucccggaaaugacaacagcacagcaacgcugugccuggggcaucaugcagugccaaacggaacucuagugaaaacaaucacgaaugaucaaauugaagugacuaaugcuacugagcugguucagaguuccucaacagguagaauaugcgacaguccucaccgaauccucgauggaaaaaacugcacacugauagaugcucuauugggagacccucauugugauggcuuccaaaauaaggaaugggaccuuuuuguugaacgcagcaaagcuuacagcaauuguuacccuuaugaugugccagauuacgccucccuuaggucacuaguugccucaucaggcacccuggaguuuaucaaugaagacuucaauuggacuggagucgcucagaauggggacagcuaugcuugcaaaaggggaucuguuaaaaguuucuuuaguagauugaauugguugcacgaaucagaauacaaauauccagcgcugaacgugacuaugccaaacaaugacaaauuugacaaguuguacauuugggggguucaccacccgagcacggacagagaacaaaccagccuauauauucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaucuaauugcuccucgggguuacuucaaaauacgaacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugaaggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39137 - RNA, 1701 nt, Artificial Sequence
  hemagglutinin__InfluenzaA__AFG99998
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugaguugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaccccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39138 - RNA, 1701 nt, Artificial Sequence; identical to SEQ ID NO: 39107
  hemagglutinin__InfluenzaA__AFH00021

SEQ ID NO: 39139 - RNA, 1701 nt, Artificial Sequence
  hemagglutinin__InfluenzaA__AFH00032
augaagacuaucauugcuuugagcuacauuuuauguuugguuuucgcccaaaaacuucccggaaaugacaacagcacagcaacgcugugccuggggcaucaugcagugccaaacggaacucuagugaaaacaaucacgaaugaucaaauugaagugacuaaugcuacugagcugguucagaguuccucaacagguaaaauaugcgacaguccucaccgaauccucgauggaaaaaacugcacacugauagaugcucuauugggagacccucauugugaugacuuccaaaauaaggaaugggaccuuuuuguugaacgcagcaaagcuuacagcaauuguuacccuuaugaugugccagauuaugccucccuuaggucacuaguugccucaucaggcacccuggaguuuaucaaugaagacuucaauuggacuggagucgcucagaguggggacagcuaugcuugcaaaaggggaucuguuaaaaguuucuuuaguagauugaauugguugcacgaaucagaauacaaauauccagcgcugaacgugacuaugccaaacaaugacaaauuugacaaguuguacauuugggggguucaccacccgagcacggacagagaacaaaccagccuauauauucgagcaucagggagagucacagucucuaccaaaagaagucaacaaacuguaaucccaaauaucggguccagacccuggguaaggggucuguccaguagaauaagcaucuauuggacaauaguaaaaccgggagacauacuuuugauuaauagcaccgggaaucuaauugcuccacgggguuacuucaaaauacgaacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugaaggcacaggacaagcagcagaucuuaaaagcacucaagcagcaaucgaccaaaucaacgggaaacugaauaaguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39140 - RNA, 1701 nt, Artificial Sequence
  hemagglutinin__InfluenzaA__AFH00043
augaagacuaucauugcuuugagcuacauuuuauguuugguuuucgcccaaaaacuucccggaaaugacaacagcacagcaacgcugugccuggggcaucaugcagugccaaacggaacucuagugaaaacaaucacgaaugaucaaauugaagugacuaaugcuacugagcugguucagaguuccucaacagguaaaauaugcgacaguccucaccgaauccucgauggaaaaaacugcacacugauagaugcucuauugggagacccucauugugaugacuuccaaaauaaggaaugggaccuuuuuguugaacgcagcaaagcuuacagcaauuguuacccuuaugaugugccagauuaugccucccuuaggucacuaguugccucaucaggcacccuggaguuuaucaaugaagacuucaauuggacuggagucgcucagaguggggacagcuaugcuugcaaaaggggaucuguuaaaaguuucuuuaguagauugaauugguugcacgaaucagaauacaaauauccagcgcugaacgugacuaugccaaacaaugacaaauuugacaaguuguacauuugggggguucaccacccgagcacggacagagaacaaaccagccuauauauucgagcaucagggagagucacagucucuaccaaaagaagucaacaaacuguaaucccaaauaucggguccagacccuggguaaggggucuguccaguagaauaagcaucuauuggacaauaguaaaaccgggagacauacuuuugauuaauagcaccgggaaucuaauugcuccacgggguuacuucaaaauacgaacugggaaaagcucgauaaugaggucagaugcaaccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugaaggcacaggacaagcagcagaucuuaaaagcacucaagcagcaaucgaccaaaucaacgggaaacugaauaaguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39141 - RNA, 1701 nt, Artificial Sequence
  hemagglutinin__InfluenzaA__AFH00054
augaagacuaucauugcuuugagcuacauuuuaugucugguuuucgcccaaaaacuucccggaaaugacaacagcacagcaacgcugugccuggggcaucaugcagugccaaacggaacucuagugaaaacaaucacgaaugaucaaauugaagugacuaaugcuacugagcugguucagaguuccucaacagguagaauaugcgacaguccucaccgaauccucgauggaaaaaacugcacacugauagaugcucuauugggagacccucauugugauggcuuccaaaauaaggaaugggaccuuuuuguugaacgcagcaaagcuuacagcaauuguuacccuuaugaugugccagauuaugccucccuuaggucacuaguugccucaucaggcacccuggaguuuaucaaugaagacuucaauuggacuggagucgcucagaauggggacagcuaugcuugcaaaaggggaucuguuaaaaguuucuuuaguagauugaauugguugcacgaaucagaauacaaauauccagcgcugaacgugacuaugccaaacaacgacaaauuugacaaguuguacauuugggggguucaccacccgagcacggacagagaacaaaccagccuauauauucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaucuaauugcuccucgggguuacuucaaaauacggacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugaaggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccauaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39142 - RNA, 1701 nt, Artificial Sequence
  hemagglutinin__InfluenzaA__AFH00065
augaagacuaucauugcuuugagcuacauuuuaugucugguuuucgcucaaaaacuucccggaaaugacaacagcacagcaacgcugugccugggacaucaugcagugccaaacggaacacuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucgucaggcacccuggaguuuaucaaugaagacuucaauuggacuggagucgcucaggaugggggaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucagcccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39143 - RNA, 1701 nt, Artificial Sequence
  hemagglutinin__InfluenzaA__AFH00076
augaagacuaucauugcuuugagcuacauuuuaugucugguuuucgcccaaaaacuucccggaaaugacaacagcacagcaacgcugugccuggggcaucaugcagugccaaacggaacucuagugaaaacaaucacgaaugaucaaauugaagugacuaaugcuacugagcugguucagaguuccucaacagguaaaauaugcgacaguccucaccgaauccucgauggaaaaaacugcacacugauagaugcucuauugggagacccucauugugaugacuuccaaaauaaggaaugggaccuuuuuguugaacgcagcaaagcuuacagcaauuguuacccuuaugaugugccagauuaugccucccuuaggucacuaguugccucaucaggcacccuggaguuuaucaaugaagacuucaauuggacuggagucgcucagaguggggacagcuaugcuugcaaaaggggaucuguuaaaaguuucuuuaguagauugaauugguugcacgaaucagaauacaaauauccagcgcugaacgugacuaugccaaacaaugacaaauuugacaaguuguacauuugggggguucaccacccgagcacggacagagaacaaaccagccuauauauucgagcaucagggagagucacagucucuaccaaaagaagucaacaaacuguaaucccaaauaucggguccagacccuggguaaggggucuguccaguagaauaagcaucuauuggacaauaguaaaaccgggagacauacuuuugauuaauagcaccgggaaucuaauugcuccacgggguuacuucaaaauacgaacugggaaaagcucgauaaugaggucagaugcacccauuggcaccugcaauucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagaaaaacaaacuagaggcauauucggcgcaauugcagguuucauagaaaaugguugggagggaaugguagacgguugguacgguuucaggcaucaaaauucugaaggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugaacugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39144 - RNA, 1701 nt, Artificial Sequence
  hemagglutinin__InfluenzaA__AFH00087
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcgaagcuuacagcagcuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaucacccgagcacggacagugaccaaaccagccuauauguucgagcaucagggagagucacagucucuaccaaaagaagccaacaaacuguaaucccgaauaucgggucuagacccuggguaaggggucaguccaguagaauaggcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaagaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39145 - RNA, 1701 nt, Artificial Sequence
  hemagglutinin__InfluenzaA__AFH00098
augaagacuaucauugcuuugagcuacauuuuaugucugguuuucgcucaaaaacuucccggaaaugacaacagcacagcaacgcugugccugggacaucaugcagugccaaacggaacacuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucgucaggcacccuggaguuuaucaaugaagacuucaauuggacuggagucgcucaggaugggggaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucugcccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaucucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39146 - RNA, 1701 nt, Artificial Sequence
  hemagglutinin__InfluenzaA__AFH00109
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuauacuugcaaaaggggaucuguuaacaguuucuuuaguagauugaauuggcugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39147 - RNA, 1701 nt, Artificial Sequence
  hemagglutinin__InfluenzaA__AFH00120
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacagcccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaccaugugggccugccaaaaaggcaacauuaggugcaacauuugcauuuga

SEQ ID NO: 39148 - RNA, 1701 nt, Artificial Sequence
  hemagglutinin__InfluenzaA__AFH00131
augaagacuaucauugcuuugagcuacauuuuaugucugguuuuugcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuauacuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcguuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39149 - RNA, 1701 nt, Artificial Sequence
  hemagglutinin__InfluenzaA__AFH00153
augaagacuaucauugcuuugagcuacauuuuaugucugguuuuugcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauauucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39150 - RNA, 1701 nt, Artificial Sequence
  hemagglutinin__InfluenzaA__AFH00164
augaagacuaucauugcuuugagcuacauuuuaugucugguuuucgcccaaaaacuucccggaaaugacaacagcacagcaacgcugugccuggggcaucaugcagugccaaacggaacucuagugaaaacaaucacgaaugaucaaauugaagugacuaaugcuacugagcugguccagaguuccucaacagguagaauaugcgacaguccucaccgaauccucgauggaaaaaacugcacacugauggaugcucuauugggagacccucauugugauggcuuccaaaauaaggaaugggaccuuuuuguugaacgcagcaaagcuuacagcaauuguuacccuuaugaugugccagauuaugccucccuuaggucacuaguugccucaucaggcacccuggaguuuaucaaugaagacuucaauuggacuggagucgcucagaauggggacagcuaugcuugcaaaaggggaucuguuaaaaguuucuuuaguagauugaauugguugcacgaaucagaauacaaauauccagcgcugaacgugacuaugccaaacaaugacaaauuugacaaguuguacauuugggggguucaccacccgagcacggacagagaacaaaccagccuauauauucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaucuaauugcuccucgggguuacuucaaaauacgaacugggaaaagcucgauaaugaggucagaugcacccauuggcaccugcaguucugaaugcaucacuccaaauggaagcauccccaaugacaaaccuuuucaaaauguaaacaggaucacauauggggcauguccaagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugaaggcacaggacaagcagcagaucuuaaaagcacucaagcagcaaucgaccaaaucaacgggaaacugaauagguuaaucgagaaaacgaacgagaaauuccaucaaauugaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39151 - RNA, 1701 nt, Artificial Sequence
  hemagglutinin__InfluenzaA__AFH00175
augaagacuaucauugcuuugagcuacauuuuaugucugguuuuugcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaaaaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaaaaagccaacaaacuguaaucccgaauaucgggucuagacccuggguaaggggucaguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39152 - RNA, 1701 nt, Artificial Sequence
  hemagglutinin__InfluenzaA__AFH00186
augaagacuaucauugcuuugagccacauuuuaugucugguuuucgcucaaaaacuucccggaaaugacaacagcacagcaacgcuaugccugggacaucaugcagugccaaacggaacgcuagugaaaacaaucacgaaugaucaaauugaagugacuaaugcuacugaguugguucagaguucuucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaauuuaucaaugaagacuucaauuggacuggagucgcucaggaugggggaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccuagcacggacagugaccaaaccagccuauauguucgagcaucagggagagucacagucucuaccaaaagaagccaacaaacuguaaccccgaauaucgggucuagacccuggguaaggggucaguccaguagaauaagcaucuauuggacaauaguaaaaccgggagacauacuuuugauuaguagcacagggaaucuaauugcuccucgggguuacuucaaaauacgaaaugggaaaagcucaauaaugaggucagauguacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguaugguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguggaagggagaauucaggaccucgagaaauauguugaagacacuaaaauagaucucuggucuuacaacgcggagcuuauuguugccuuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39153 - RNA, 1701 nt, Artificial Sequence
  hemagglutinin__InfluenzaA__AFH00197
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugaccaaugcuacugagcugguucagaguuccucaacagguagaauaugcgacaguccucaccgaauccuugauggaaaaaacugcacacuaauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuauacuugcaaaaggggaucuguuaacaguuucuuuaguagauugaauugguugcacaaauuagaauacaaauauccagcucugaacgugacuaugccaaacaauggcaaauuugacaaauuguacauuugggggguucaccacccgagcacggacagugaccaaaccagccuauauguucgagcaucagggagagucacagucucuaccaaaauaagccaacaaacuguaaucccgaauaucgggucuagacccuggguaaggggucuguccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagggacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39154 - RNA, 1701 nt, Artificial Sequence
  hemagglutinin__InfluenzaA__AFH00208
augaagacuaucauugcuuugagcuacauuuuaugucugguuuucgcccaaaaacuucccggaaaugacaacagcacagcaacgcugugccuggggcaucaugcagugccaaacggaacucuagugaaaacaaucacgaaugaucaaauugaagugacuaaugcuacugagcugguucagaguuccucaacagguagaauaugcgacaguccucaccgaauccucgauggaaaaaacugcacacugauagaugcucuauugggagacccucauugugauggcuuccaaaauaaggaaugggaccuuuuuguugaacgcagcaaagcuuacagcaauuguuacccuuaugaugugccagauuaugccucccuuaggucacuaguugccucaucaggcacccuggaguuuaucaaugaagacuucaauuggacuggagucgcucagaauggggacagcuaugcuugcaaaaggggaucuguuaaaaguuucuuuaguagauugaauugguugcacgaaucagaauacaaauauccagcgcugaacgugacuaugccaaacaaugacaaauuugacaaguuguacauuugggggguucaccacccgagcacggacagagaacaaaccagccuauauauucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaucuaauugcuccucgggguuacuucaaaauacgaacugggaaaagcucgguaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugaaggcacaggacaagcagcagaucuuaaaagcacucaagcagcaaucgaccaaaucaacgggaaacugaguagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacuaagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39155 - RNA, 1701 nt, Artificial Sequence
  hemagglutinin__InfluenzaA__AFH00219
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucacaggauccuugauggaaaaaacugcacacugauagaugcucuauugggagacccuaauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucaggaugggggaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaccccgaauaucgggucuagacccuggguaaggggucuguccaguagaauaagcaucuauuggacaauaguaaaaccgggagacauacuuuugauuaauagcacaggaaaucuaauugcuccucgggguuacuucaagauacgaaaugggaaaagcucaauaaugaggucagaugcacccauuggcaccugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgauaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39156 - RNA, 1701 nt, Artificial Sequence
  hemagglutinin__InfluenzaA__AFH00230
augaagacuaucauugcuuugagcuacauuuuaugucuggucuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaaaaguuucuuuaguagauugaauugguugcacaaauuagaauacaaauauccagcgcugaacgugacuaugccaaacaauggcaaauuugacaaauuguacauuugggggguucaccacccgagcacgaacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuucaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39157 - RNA, 1701 nt, Artificial Sequence
  hemagglutinin__InfluenzaA__AFH00241
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuucaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39158 - RNA, 1701 nt, Artificial Sequence
  hemagglutinin__InfluenzaA__AFH00252
augaagacuaucauugcuuugagcuacauuuuaugucugguuuucgcccaaaaacuucccggaaaugacaacagcacagcaacgcugugccuggggcaucaugcagugccaaacggaacucuagugaaaacaaucacgaaugaucaaauugaagugacuaaugcuacugagcugguucagaguuccucaacagguagaauaugcgacaguccucaccgaauccucgauggaaaaaacugcacacugauagaugcucuauugggagacccucauugugaugacuuccaaaauaaggaaugggaccuuuuuguugaacgcagcaaagcuuacagcaauuguuacccuuaugaugugccagauuaugccucccuuaggucacuaguugccucaucaggcacccuggaguuuaucaaugaagacuucaauuggacuggagucgcucagaguggggacagcuaugcuugcaaaaggggaucuguuaaaaguuucuuuaguagauugaauugguugcacgaaucagaauacaaauauccagcgcugaacgugacuaugccaaacaaugacaaauuugacaaguuguacauuugggggguucaccacccaagcacggacagagaacaaaccagccuauauauucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaucuaauugcuccacgggguuacuucaaaauaagaacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugaaggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagauaaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39159 - RNA, 1701 nt, Artificial Sequence
  hemagglutinin__InfluenzaA__AFH00263
augaagacuaucauugcuuugagcuacauuuuacaucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccuaauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucaggaugggggaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacaguguccaaaccagccuauauguucgagcaucagggaaagucacagucucuaccaaaagaagccaacaaacuguaaccccgaauaucgggucuaaacccuggguaaggggucuguccaguagaauaagcaucuauuggacaauaguaaaaccgggagacauacuuuugauuaauagcacaggaaaucuaauugcuccucgggguuacuucaaaauacgaaaugggaaaagcucaauaaugaggucagaugcacccauuggcaccugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39160 - RNA, 1701 nt, Artificial Sequence
  hemagglutinin__InfluenzaA__AFH00274
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauuggcugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguggaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39161 - RNA, 1701 nt, Artificial Sequence
  hemagglutinin__InfluenzaA__AFH00285
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugaguugguucagaguuccucaacagguagaauaugcggcaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcaaaagaggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaccccgaauaucgggucuagacccuggguaaggggucaguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacagaaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39162 - RNA, 1701 nt, Artificial Sequence
  hemagglutinin__InfluenzaA__AFH00296
augaagacuaucauugcuuugagcuacauuuucugucugguuuucgcccaaaaacuucccggaaaugacaacagcacagcaacgcugugccugggacaucaugcagugccaaacggaacacuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuucaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagagugggggaagcuaugcuugcaaaaggggaucuguuaacaguuucuuuaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucaaccaaaagaagccagcaaacuguaaucccgaauaucgggucuagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucaauaaugaggucagaugcacccauuggcaccugcaguucugaaugcaucacuccaaauggaagcauucccaaugacaaacccuuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccacaucaugcuuuuugcuuuguguuguuuugcugggguucaucaugugggccugccaaaaaggcaacauuaggugcaacauuugcauuuga

SEQ ID NO: 39163 - RNA, 1701 nt, Artificial Sequence
  hemagglutinin__InfluenzaA__AFH00307
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugaguugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguuagagcaucagggagagucacagucucuaccaaaagaagccaacaaacuguaaccccgaauaucgggucuagacccuggguaaggggucaguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggaucuccuuugccauaucaugcuuuuugcuuuguguuguuuugcugggguucaucaugugggccugccaaaaaggcaacauuaggugcaacauuugcauuuga

SEQ ID NO: 39164 - RNA, 1701 nt, Artificial Sequence; identical to SEQ ID NO: 39163
  hemagglutinin__InfluenzaA__AFH00318

SEQ ID NO: 39165 - RNA, 1701 nt, Artificial Sequence
  hemagglutinin__InfluenzaA__AFH00329
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacagucaucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagcauauauguucgagcaucagggagagucacagucucuaccaaaagaagccaacaaacuguaaucccgaauaucggaucuagacccuggguaagggguaucuccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaauucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauccaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcacuaaacaaccgguuccagaucaaagguguugagcugaagucaggauacaaagauuggauccuauggauuuccuuugccacaucaugcuuuuugcuuuguguuguuuugcugggguucaucaugugggccugccaaaaaggcaacauuaggugcaacauuugcauuuaa

SEQ ID NO: 39166 - RNA, 1701 nt, Artificial Sequence
  hemagglutinin__InfluenzaA__AFH00340
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacagacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaguagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauauaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39167 - RNA, 1701 nt, Artificial Sequence
  hemagglutinin__InfluenzaA__AFH00351
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaggaaggcuucaauuggacuggagucgcucaggaugggaaaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucgggucuagacccuggguaagggguaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauuggcaacugcaauucugaaugcaucacuccagauggaagcauucccaaugacaaaccuuuucaaaauguaaacaggaucacauauggggccugucccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacaagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39168 - RNA, 1701 nt, Artificial Sequence
  hemagglutinin__InfluenzaA__AFH00362
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggggucgcucaggaugggaaaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucggguccagacccugggugaggggcaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcugagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccacaucaugcuuuuugcuuuguguuguuuugcugggguucaucaugugggccugccaaaaaggcaacauuaggugcaacauuugcauuuga

SEQ ID NO: 39169 - RNA, 1701 nt, Artificial Sequence
  hemagglutinin__InfluenzaA__AFH00384
augaagaccaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaggaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucgggucuagacccuggguaagggguaucuccaguagaauaagcaucuauuggacaauaguaaaaccgggagacauacuuuugauuaacagcauagggaaucuaauugcuccucgggguuacuucaaaauacgaaaugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaagcugaauagguuaaucgagaaaacgaacgaaaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39170 - RNA, 1701 nt, Artificial Sequence
  hemagglutinin__InfluenzaA__AFH00395
augaaggcuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaggaaggcuucaauuggacuggagucgcucaggaugggaaaagcuaugcuugcaaaaggggaucuguuaacgguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucgggucuagacccuggguaagggguaucuccaguagaauaagcaucuauuggacaauaguaaaaccgggagacauacuuuugauuaaaagcacagggaaucuaauugcuccucgggguuacuucaaaauacgaaaugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaguuggcaacagggaugcggaauguaccagagaaacaaacuagaggcauauucggcgcaaucgcagguuucauagaaaaugguugggagggaaugguagaugguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39171 - RNA, 1701 nt, Artificial Sequence
  hemagglutinin__InfluenzaA__AFH00417
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggagucgcucaggaugggaaaagcuaugcuugcaaaaggggaucuguuaagaguuucuuuaguagauugaauugguugcacaaauuagaauacaaauauccagcacugaacgugacuaugccaaacaaugacaaauuugacaaacuguacauuugggggguucaccacccgagcacggacagugaccaaaccagccuauauguucaggcaucagggagagucacagucucuaccaaaagaagccaacaaacuguaaucccgaauaucggguccagacccugggugaggggcauuuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaagagcacucaagcagcaaucgaucaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39172 - RNA, 1701 nt, Artificial Sequence
  hemagglutinin__InfluenzaA__AFH00428
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguucuccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagacuacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguuuuguuuugcuuggguucaucaugugggccugccaaaaaggcaacauuaggugcaacauuugcauuuga

SEQ ID NO: 39173 - RNA, 1701 nt, Artificial Sequence
  hemagglutinin__InfluenzaA__AFH00439
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaaugugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaagaggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugagcaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39174 - RNA, 1701 nt, Artificial Sequence
  hemagglutinin__InfluenzaA__AFH00450
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacgguccucaccgaaucauugauggaaaaaacugcacacugauagaugcucuauugggagacccucauugugauggcuuccaaaauaaggaaugggaccuuuuuguugaacgcagcaaagcuuacagcaacuguuacccuuaugaugugccagauuaugccucccuuaggucacuaguugccucauccggcacccuggaguuuaccaaugaaagcuucaauuggacuggagucgcucagaauggaacaagcuaugcuugcaaaaggggaucuguuaaaaguuucuuuaguagauugaauugguugcacaaauuagaauacaaauauccagcacuaaacgugacuaugccaaacaaugacaaauuugacaaauuguacauuugggggguucaccacccgaguacggacagugaccaaaccagccuauauguucaaucaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugauagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcagagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39175 - RNA, 1701 nt, Artificial Sequence
  hemagglutinin__InfluenzaA__AFH00461
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccggauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaacgaaaacuucaauuggacuggagucgcucaggaugggaaaagcuaugcuugcaaaaggggaucuguuaacaguuucuuuaguagauugaauugguugcacaaauuagacuacaaauacccagcgcugaacgugacuaugccaaacaauggcaaauuugacaaauuguacauuugggggguucaccacccgagcacugacagugaccaaaucagccuauauguccgaucaucagggagagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaacuacgaaaugggaaaagcucaauaaugaggucagaugcacccauuggcaacugcaguucuggaugcaucacuccaaauggaagcauucccaaugacaaaccuuuucaaaauguaaacaggaucacuuauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuguuugaaagaacaaggaagcaacugagggaaaaugcugaggacaugggcaaugguuguuucaaaauauaccacaagugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 39176 - RNA, 1701 nt, Artificial Sequence
  hemagglutinin__InfluenzaA__AFH00472
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugucggauuaugccucccuuaggucacuaguugccucauccgguacccuggaguuuaacaaugaaagcuucaauuggacuggagucgcucagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaauaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39177 - RNA, 1701 nt, Artificial Sequence
  hemagglutinin__InfluenzaA__AFH00483
augaagacuaucauugcuuugagcuacauuuuauguaugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguaaaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39178 - RNA, 1701 nt, Artificial Sequence
  hemagglutinin__InfluenzaA__AFH00494
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuuuugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggagagucacagucucuaccaaaagaagccaacaaacuguaaucccggauaucggguauagaccauggguaaggggucaguccaguagaauaggcaucuauuggacaauaguaaaaccgggagacauacuucugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcugcagaucuuaaaagcacucaagcagcaaucgaccaaaucaacgggaagcugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuguuugaaagaacaaggaagcaacugagggaaaaugcugaggacaugggcaaugguuguuucaaaauauaccacaaaugugacaaugccugcauagggucaaucagaaauggaacuuauaaccaugauguauacagagacgaagcauuaaacaaccgguuccagaucaaagguguugagcugaagucaggauacaaagauuggauucuauggauuuccuuugccauaucaugcuuuuugcuuuguguuguuuugcuuggguucaucaugugggccugccaaaaaggcaacauuaggugcaacauuugcauuuga

SEQ ID NO: 39179 - RNA, 1701 nt, Artificial Sequence
  hemagglutinin__InfluenzaA__AFH00505
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacaaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaccaaugaaggcuucaauuggacuggaguugcucaggauggaacaagcuaugcuugcaaaaggggaucuguuaaaaguuucuuuaguagauugaauugguugcacaaauuagaauacaaauauccagcacugaacguuacuaugccaaacaaugacaaauuugacaaauuguacauuugggggguucaccacccgaguacggacagugaccaaaucagccuauauguucaagcaucagggagagucacagucucuaccaaaagaagccaacaaacuguaaucccgaauaucgggucuagacccuggguuaggggugucuccagcauaauaagcaucuauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39180 - RNA, 1701 nt, Artificial Sequence
  hemagglutinin__InfluenzaA__AFH00516
augaagacuaucauugcuuugagcuacauuuuaugucagguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucggguccagacccugggugaggggcaucuccaguagaauaagcaucuauuggacaauaguaaaaccgggagacauacuuuugauuaaaagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacccugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaaaucaacgggaaacugaauagauuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucgggauacaaagauuggauccuauggauuucuuuugccauaucaugcuuuuugcuuuguguuguuuugcugggguucaucaugugggccugccaaaaaggcaacauuaggugcaacauuugcauuuga

SEQ ID NO: 39181 - RNA, 1701 nt, Artificial Sequence
  hemagglutinin__InfluenzaA__AFH00527
augaagacuaucauugcuuugagcuacauuuuaugucugguuuucgcucaaaaaauucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucaucuggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcauccauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39182 - RNA, 1701 nt, Artificial Sequence
  hemagglutinin__InfluenzaA__AFH00538
augaagacuaucauugcuuugagcuacauuuuaugucugguuuucgcucaaaaaauucccggaaaugacaacagcacggcaacgcugugccugggacaccaugcagugccaaacggaacgcuagugaaaacaaucacgaaugaccaaauugaagugacuaaugcuacugagcugguucagagguccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugcaucauccggcacccuggaguuuaacaaugaaagcuucaauuggacuggagucgcucagaauggaacaagcuaugcuugcaaaaggagaucuauuaaaaguuucuuuaguagauugaacugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39183 - RNA, 1701 nt, Artificial Sequence
  hemagglutinin__InfluenzaA__AFH00549
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugauguaccggauuaugccucccuuaggucacuaguugccucauccggcacccuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaccagggagagucacagucucuaccagaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuagcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcagagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39184 - RNA, 1701 nt, Artificial Sequence
  hemagglutinin__InfluenzaA__AFH00560
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacauuccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacaguacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaagcagaagggagaauucaggaccucgagaaauauguugaggacacuaaaauagaccucuggucguacaacgcggagcuucuuguugcccuggagaaccaacauacaauugaucuaacugacucagaaaugaacaaacuguuugaaagaacaaggaagcaacugagggaaaaugcugaggauauggguaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 39185 - RNA, 1701 nt, Artificial Sequence
  hemagglutinin__InfluenzaA__AFH00571
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugacaacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaacgaaagcuucaauuggacuggagucgaucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggaaaaugcaauucugaaugcaucacuccaaauggaagcauucccaaugacaaaccauuucaaaauguaaacaggaucacauauggggccugucccagauauguuaaacaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguucgaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuaa

SEQ ID NO: 39186 - RNA, 1701 nt, Artificial Sequence
  hemagglutinin__InfluenzaA__AFH00582
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagcuuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccacaucauguuuuuugcuuuguguugucuugcugggguucaucaugugggccugccaaaaaggcaacauuaggugcaacauuugcauuuga

SEQ ID NO: 39187 - RNA, 1701 nt, Artificial Sequence
  hemagglutinin__InfluenzaA__AFH00593
augaagacuaucauugcuuugagcuacauuuuaugccugguuuucgcucaaaaacuucccggaaaugacaacagcacggcaacgcugugccuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuugcauuguuuugcugggguucaucaugugggccugccaaaaaggcaacauuaggugcaacauuugcauuuga

SEQ ID NO: 39188 - RNA, 1701 nt, Artificial Sequence; identical to SEQ ID NO: 39187
  hemagglutinin__InfluenzaA__AFH00604

SEQ ID NO: 39189 - RNA, 1701 nt, Artificial Sequence
  hemagglutinin__InfluenzaA__AFH00615
augaagacuaucauugcuuugagcuacauucuaugucugguuuucgcucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauuaaauugguugacccacuuaaaguacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggacaucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagagucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39190 - RNA, 1701 nt, Artificial Sequence
  hemagglutinin__InfluenzaA__AFH00626
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaacuggacuggagucacucagaauggaacaagcucugcuugcaaaaggaaaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuguaugcucaagcaucaggaagaaucacagucucuaccaaaagaagccaacaaacuguaaucccgaauaucggaucuagacccaggguaagggacgucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39191 - RNA, 1701 nt, Artificial Sequence
  hemagglutinin__InfluenzaA__AFH00637
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucuucuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauauacucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39192 - RNA, 1701 nt, Artificial Sequence
  hemagglutinin__InfluenzaA__AFH00648
augaagacuaucauugcuuugagcuacauucuaugucugguuuucgcucaaaaacuucccggaaaugacgacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacgaugaaagcuucaauuggacuggagucacucaaaauggaacaagcucuucuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccgguuacggacaaugaccaaaucuuccuguaugcucaagcaucaggaagaaucacagucucuaccaaaagaagccaacaaacuguaaucccgaauaucggaucuagacccagaauaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39193 - RNA, 1701 nt, Artificial Sequence
  hemagglutinin__InfluenzaA__AFH00659
augaagacuaucauugcuuugagcuacauucuaugucugguuuuuacucaaaaacuucccggaaaugacaacagcacggcaacgcugugccuugggcaccaugcaguaccaaacggaacgauggugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagcccacagcaacuguuacccuuaugaugugccggauuaugccucccuuaggucacuaauugccucauccggcacccuggaguuuaacaaugaaagcuucaauuggacuggagucacucaaaaugggacaagcucugcuugcaaaaggagaucugauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucuggaugcaucacuccaaauggaagcauucccaaugacaaaccauuucaaaauguaaacaggaucacauauggggccugucccagauauguuaagcaaaacacucuaaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39194 - RNA, 1701 nt, Artificial Sequence
  hemagglutinin__InfluenzaA__AFH00670
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucuccacccggguacggacaaugaccaaaucuuccuguaugcucaagcaucaggaagaaucacagucucuaccaaaagaagucaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39195 - RNA, 1701 nt, Artificial Sequence
  hemagglutinin__InfluenzaA__AFH00681
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacauuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaagaaaaauuugacaaauuguacauuugggggguucaccacccggguacggacaaugaccaaaucuuccuguaugcucaagcaucaggaagaaucacagucucuaccaaaagaagucaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39196 - RNA, 1701 nt, Artificial Sequence
  hemagglutinin__InfluenzaA__AFH00692
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucaugcuuuuugcuuuguguugcuuuguugggguucaucaugugggccugccaaaaaggcaacauuaggugcaacauuugcauuuga

SEQ ID NO: 39197 - RNA, 1701 nt, Artificial Sequence
  hemagglutinin__InfluenzaA__AFH00703
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacaaaugaccaaauugaaguuacuaaugcuacugagcugguucagaguucuucaacagguaaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugcuucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguuaacccacuuaaacuucaaauacucagcauugaacgugacuaugccgaacaaugaacaauuugacaaauuguacauuugggggguucaccacccggguacggacaaagaccaaaucuuccuguaugcccaagcaucaggaagaaucacagucucuaccaaaaggagccaacaaacuguaaucccgaauaucggaucuagaccccgaguaaggaauaucccuagcagaauaagcaucuauuggacaauaguaaaaccgggagacauacuuuugauuaacagcacagggaaucuaauugcuccuagggguuacuucaaaaugcaaagugggaaaagcucaauaaugagaucagaugcacccauuggcaaaugcaauucugaaugcaucacuccaaauggaagcauucccaaugacaaaccauuccaaaaugugaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaguuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39198 - RNA, 1701 nt, Artificial Sequence
  hemagglutinin__InfluenzaA__AFH00714
augaagacuaucauugcuuugagcuacauuuucugucugguuuucgcccaaaaccuucccggaaaugacaacagcacagcaacgcugugccugggacaccaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuaucaaugaaggcuucaauuggacuggagucacucagagugggggaagcuaugcuugcaaaaggggaucugauaaaaguuucuucaguagacugaauugguuguacgaaucagaaagcaaauauccagugcugaacgugacuaugccaaacaauggcaauuuugacaaacuguacauuugggggguucaccacccgagcacggacaaagaacaaaccaaccuauauguucgagcaucagggagagucacagucucuaccaagagaagccagcaaacuauaaucccgaauaucgggucuagacccuggguaaggggucugucuaguggaauaaguaucuauuggacaauaguaaaaccgggagacauacuguuaauuaauaguaaugggaaccuaauugcuccucgggguuacuucaaaauacgcacugggaaaagcucaauaaugaggucagaugcaccuauuggcaccugcaguucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauacguugaagacacuaaaauagaucucuggucuuacaacgcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39199 - RNA, 1701 nt, Artificial Sequence
  hemagglutinin__InfluenzaA__AFH00725
augaagacuaucauugcuuugagcuacauuuucugucugauuuucgcccaaaaccuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccagauuaugccucccuuaggucacuaguugccucaucaggcacccuggaguuuaucaaugaaggcuucaauuggacuggagucacucagagugggggaagcuaugcuugcaaaaggggaucugauaacaguuucuucaguagacugaacugguuguacgaaucagaaagcaaauauccagugcugaacgugacuaugccaaacaauggcaaauuugacaaauuguacauuugggggguucaccacccgagcacggacaaagaacaaaccaaacuauauguucgagcaucagggagagucacagucucuaccaagagaagccagcaaacuguaaucccgaauaucgggucuagacccuggguaaggggucugucuaguagaauaaguaucuauuggacaauaguaaaaccgggagacauacuguuaauuaauagcacugggaaccuaauugcuccucgggguuacuucaaaauacgcacugggaaaagcucaauaaugaggucagaugcaccuauuggcaccugcaguucugaaugcaucacuccaaauggaagcauucccaaugacaagcccuuucaaaacguaaacaagaucacauauggggcaugucccagguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcucuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugcuugcauagggucaaucagaaauggaacauaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39200 - RNA, 1701 nt, Artificial Sequence
  hemagglutinin__InfluenzaA__AFH00736
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucacucagagugggggaagcuaugcuugcaaaaggggaucuguuaaaaguuucuucaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucuaccaagagaagccagcaaacuguaauuccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgcacugggaaaagcucaauaaugaggucagaugcaccuauuggcaccugcagcucugaaugcaucacuccaaauggaagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggaucuuauggauuuccuuugccauaucaugcuuuuugcuuuguguuguuuugcugggguucaucaugugggccugccaaaaaggcaacauuaggugcaacauuugcauuuga

SEQ ID NO: 39201 - RNA, 1701 nt, Artificial Sequence
  hemagglutinin__InfluenzaA__AFH00747
augaagacuaucauugcuuugagcuacauuuucugucugguuuucgcccaaaaacuucccggaaaugacaacagcacagcaacgcugugccugggacauuaugcagugccaaacggaacacuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugacggcuuccaaaaugagaaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucacucagagugggggaagcuaugcuugcaaaaggggaucuguuaaaaguuucuucaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucuaccaagagaagccagcaaacuguaaucccgaauaucgggucuaggcccuggguaaggggucuguccaguagaauaagcaucuauuggacaauaguaaaaccgggagacauacuguugauuaauagcaccgggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagauauguuaagcaaaacacucugaaauuggcaacagggaugcggaauguaccagagaaacaaacuagaggcauauucggcgcaauagcagguuucauagaaaaugguugggagggaaugguagacggcugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauaggaucaaucagaaauggaacuuaugaccaugauguauacagagacgaagcauuaaacaaccgguuccagaucaaagguguugagcugaaaucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39202 - RNA, 1701 nt, Artificial Sequence
  hemagglutinin__InfluenzaA__AFH00758
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagaguggggaaagcuaugcuugcaaaaggggaucuguuaaaaguuucuuuaguagauugaauugguugcacgaaucagaauacaaauauccagcgcugaacgugacuaugccaaacaauggcaaauuugacaaauuguacauuugggggguucaccacccgagcacggacagagaacaaaccaaacuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucaauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39203 - RNA, 1701 nt, Artificial Sequence
  hemagglutinin__InfluenzaA__AFH00769
augaagacuaucauugcuuugagcuacauuuuaugucugguuuucgcccaaaaacuucccggaaaugacaacagcacagcaacgcugugccuggggcaucaugcagugccaaacggaacucuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccagauuaugccucccuuaggucacuaguugccucaucaggcacccuggaguuuaucaaugaagacuucaauuggacuggagucgcucagaguggggaaagcuauacuugcaaaaggggaucuguuaaaaguuucuuuaguagauugaauugguugcacgaaucagaauacaaauauccagcgcugaacgugacuaugccaaacaaugacaaauuugacaaauuguacauuugggggguucaccacccgagcacggacagagaacaaaccagccuauauauucgagcaucagggagagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39204 - RNA, 1701 nt, Artificial Sequence
  hemagglutinin__InfluenzaA__AFH00780
augagggcuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcgacuguuacccuuaugaugugccggauuaugcuucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggggucuccagcagaauaagcaucuauuggacaauaguaaaaccgggagacauacuuuugauuaauagcacagggaaucuaauugccccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcagagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39205 - RNA, 1701 nt, Artificial Sequence
  hemagglutinin__InfluenzaA__AFH00791
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucaggguuccucaacagguagaauaugcgacaguccucaccaaauccuugauggaaaaaacugcacacugauagaugcucuauugggagacccucauugugauggcuuccaaaauaaggaaugggaccuuuuugucgaacgcagcacagcuuacagcaacuguuacccuuaugaugugccggauuaugccucccuuaggucacuaguugccucauccggcacccuggaguuuaccaaagaaggcuucaauuggacuggagucgcucaggauggaacaagcuauacuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucggaugcacccauugacaacugcaauucugaaugcauuacuccaaauggaagcauucccaaugacaaaccuuuucaaaauguaaacaggaucacauauggggccugucccagauauguuaagcaaaacacucugaaauuggcaacagggaugcggaauguaccagagaaacagacuagaggcauauucggcgcaaucgcagguuucauagaaaaugguugggagggaaugguggacgguugguacgguuucaggcaucaaaacucugaaggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguucgaaagaacaagaaaacaacugagggaaaaugcugaggacaugggcaaugguugcuucaaaauauaccacaaaugugacaaugccugcauagggucaaucagaaauggaacuuaugaucaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucauuaugugggccugccaaaaaggcaacauuaggugcaacauuugcauuuga

SEQ ID NO: 39206 - RNA, 1701 nt, Artificial Sequence; identical to SEQ ID NO: 36773
  hemagglutinin__InfluenzaA__AFH00802

SEQ ID NO: 39207 - RNA, 1701 nt, Artificial Sequence
  hemagglutinin__InfluenzaA__AFH00813
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaagggauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucgaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39208 - RNA, 1701 nt, Artificial Sequence
  hemagglutinin__InfluenzaA__AFH00824
augaagacuaucauugcuuugagcuacauucuacgucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcaacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39209 - RNA, 1701 nt, Artificial Sequence
  hemagglutinin__InfluenzaA__AFH01407
augaagacuaucauugcuuugagcuacauucuaugucugguuuucgcucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcaacaguccucaucagauccuugauggagaaaacugcacacuaauagaugcucuauugggagacccucagugugauggauuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagagucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39210 - RNA, 1701 nt, Artificial Sequence
  hemagglutinin__InfluenzaA__AFH34940
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugaacugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuaggggguacuucaaaauacgaagugggaaaagcucaauaaugagaucagaugcacccauuggcaaaugcaauucugaaugcaucacuccaaauggaagcauucccaaugauaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacuggcucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39211 - RNA, 1701 nt, Artificial Sequence
  hemagglutinin__InfluenzaA__AFH34961
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauuaggagacccucagugugauggcuuccaaaauaagaagugggaccuuuuuguugaacgaagcaaagccuacagcaacuguuacccuuaugaugugccggauuaugccucccuuaggucacuaguugccgcauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccagcauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaucgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39212 - RNA, 1701 nt, Artificial Sequence
  hemagglutinin__InfluenzaA__AFH34968
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccgcauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaagcacucuaaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccagcauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39213 - RNA, 1701 nt, Artificial Sequence
  hemagglutinin__InfluenzaA__AFH34975
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggaauggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaccaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39214 - RNA, 1701 nt, Artificial Sequence; identical to SEQ ID NO: 38688
  hemagglutinin__InfluenzaA__AFH74464

SEQ ID NO: 39215 - RNA, 1701 nt, Artificial Sequence; identical to SEQ ID NO: 33803
  hemagglutinin__InfluenzaA__AFH74465

SEQ ID NO: 39216 - RNA, 1701 nt, Artificial Sequence; identical to SEQ ID NO: 33934
  hemagglutinin__InfluenzaA__AFH74477

SEQ ID NO: 39217 - RNA, 1701 nt, Artificial Sequence
  hemagglutinin__InfluenzaA__AFH74488
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaauccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacauuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaguuccaucagauugaaaaagaauucucagaaguugaagggagaauucaggaccuugagaaauauguugaggacacuaaaauagaucucuggucauacaacgcggagcuucuuguugcucuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39218 - RNA, 1701 nt, Artificial Sequence; identical to SEQ ID NO: 38648
  hemagglutinin__InfluenzaA__AFH74499

SEQ ID NO: 39219 - RNA, 1701 nt, Artificial Sequence; identical to SEQ ID NO: 38649
  hemagglutinin__InfluenzaA__AFH74510

SEQ ID NO: 39220 - RNA, 1701 nt, Artificial Sequence
  hemagglutinin__InfluenzaA__AFH74521
augaagacuaucauugcuuugagcuacauucuaugucugguuuucgcucaaaaaauuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgcagcaaagcuuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauccaaauacccagcauugaaugugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugaagucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaaguacucaagcagcaaucgaucaaaucaaugggaagcugaauagauugaucgggaaaaccaacgagaaauuccaucagauugaaaaagaauucucagaggucgaagggagaauucaggaccuugagaaauauguugaggacaccaaaguagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugcuugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39221 - RNA, 1701 nt, Artificial Sequence; identical to SEQ ID NO: 38650
  hemagglutinin__InfluenzaA__AFH74532

SEQ ID NO: 39222 - RNA, 1701 nt, Artificial Sequence; identical to SEQ ID NO: 38651
  hemagglutinin__InfluenzaA__AFH74543

SEQ ID NO: 39223 - RNA, 1701 nt, Artificial Sequence; identical to SEQ ID NO: 38651
  hemagglutinin__InfluenzaA__AFH74554

SEQ ID NO: 39224 - RNA, 1701 nt, Artificial Sequence; identical to SEQ ID NO: 38651
  hemagglutinin__InfluenzaA__AFH74565

SEQ ID NO: 39225 - RNA, 1701 nt, Artificial Sequence; identical to SEQ ID NO: 38654
  hemagglutinin__InfluenzaA__AFH74576

SEQ ID NO: 39226 - RNA, 1701 nt, Artificial Sequence; identical to SEQ ID NO: 38656
  hemagglutinin__InfluenzaA__AFH74587

SEQ ID NO: 39227 - RNA, 1701 nt, Artificial Sequence
  hemagglutinin__InfluenzaA__AFH74598
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39228 - RNA, 1701 nt, Artificial Sequence; identical to SEQ ID NO: 38657
  hemagglutinin__InfluenzaA__AFH74609

SEQ ID NO: 39229 - RNA, 1701 nt, Artificial Sequence; identical to SEQ ID NO: 38656
  hemagglutinin__InfluenzaA__AFH74620

SEQ ID NO: 39230 - RNA, 1701 nt, Artificial Sequence
  hemagglutinin__InfluenzaA__AFH74631
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaacaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaucacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39231 - RNA, 1701 nt, Artificial Sequence; identical to SEQ ID NO: 38648
  hemagglutinin__InfluenzaA__AFH74642

SEQ ID NO: 39232 - RNA, 1701 nt, Artificial Sequence; identical to SEQ ID NO: 38648
  hemagglutinin__InfluenzaA__AFH74653

SEQ ID NO: 39233 - RNA, 1701 nt, Artificial Sequence; identical to SEQ ID NO: 38648
  hemagglutinin__InfluenzaA__AFH74664

SEQ ID NO: 39234 - RNA, 1701 nt, Artificial Sequence; identical to SEQ ID NO: 38648
  hemagglutinin__InfluenzaA__AFH74675

SEQ ID NO: 39235 - RNA, 1701 nt, Artificial Sequence; identical to SEQ ID NO: 38663
  hemagglutinin__InfluenzaA__AFH74686

SEQ ID NO: 39236 - RNA, 1701 nt, Artificial Sequence; identical to SEQ ID NO: 38663
  hemagglutinin__InfluenzaA__AFH74697

SEQ ID NO: 39237 - RNA, 1701 nt, Artificial Sequence; identical to SEQ ID NO: 38664
  hemagglutinin__InfluenzaA__AFH74708

SEQ ID NO: 39238 - RNA, 1701 nt, Artificial Sequence; identical to SEQ ID NO: 38665
  hemagglutinin__InfluenzaA__AFH74719

SEQ ID NO: 39239 - RNA, 1701 nt, Artificial Sequence
  hemagglutinin__InfluenzaA__AFH74730
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugaugggaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccgggcacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39240 - RNA, 1701 nt, Artificial Sequence
  hemagglutinin__InfluenzaA__AFH74741
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcaggauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39241 - RNA, 1701 nt, Artificial Sequence; identical to SEQ ID NO: 38668
  hemagglutinin__InfluenzaA__AFH74752

SEQ ID NO: 39242 - RNA, 1701 nt, Artificial Sequence; identical to SEQ ID NO: 38668
  hemagglutinin__InfluenzaA__AFH74763

SEQ ID NO: 39243 - RNA, 1701 nt, Artificial Sequence; identical to SEQ ID NO: 38668
  hemagglutinin__InfluenzaA__AFH74774

SEQ ID NO: 39244 - RNA, 1701 nt, Artificial Sequence; identical to SEQ ID NO: 38650
  hemagglutinin__InfluenzaA__AFH74785

SEQ ID NO: 39245 - RNA, 1701 nt, Artificial Sequence; identical to SEQ ID NO: 38651
  hemagglutinin__InfluenzaA__AFH74796

SEQ ID NO: 39246 - RNA, 1701 nt, Artificial Sequence; identical to SEQ ID NO: 38673
  hemagglutinin__InfluenzaA__AFH74807

SEQ ID NO: 39247 - RNA, 1701 nt, Artificial Sequence; identical to SEQ ID NO: 38673
  hemagglutinin__InfluenzaA__AFH74818

SEQ ID NO: 39248 - RNA, 1701 nt, Artificial Sequence; identical to SEQ ID NO: 38673
  hemagglutinin__InfluenzaA__AFH74829

SEQ ID NO: 39249 - RNA, 1701 nt, Artificial Sequence; identical to SEQ ID NO: 38673
  hemagglutinin__InfluenzaA__AFH74840

SEQ ID NO: 39250 - RNA, 1701 nt, Artificial Sequence
  hemagglutinin__InfluenzaA__AFH74851
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacggcaacuguuacccuuaugaugugccggauuaugccucccuuaggucacuaguugccucauccggaacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugagauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39251 - RNA, 1701 nt, Artificial Sequence; identical to SEQ ID NO: 38676
  hemagglutinin__InfluenzaA__AFH74862

SEQ ID NO: 39252 - RNA, 1701 nt, Artificial Sequence; identical to SEQ ID NO: 38676
  hemagglutinin__InfluenzaA__AFH74873

SEQ ID NO: 39253 - RNA, 1701 nt, Artificial Sequence; identical to SEQ ID NO: 38651
  hemagglutinin__InfluenzaA__AFH74884

SEQ ID NO: 39254 - RNA, 1701 nt, Artificial Sequence; identical to SEQ ID NO: 34117
  hemagglutinin__InfluenzaA__AFH74895

SEQ ID NO: 39255 - RNA, 1701 nt, Artificial Sequence; identical to SEQ ID NO: 38680
  hemagglutinin__InfluenzaA__AFH74906

SEQ ID NO: 39256 - RNA, 1701 nt, Artificial Sequence; identical to SEQ ID NO: 34103
  hemagglutinin__InfluenzaA__AFH74917

SEQ ID NO: 39257 - RNA, 1701 nt, Artificial Sequence; identical to SEQ ID NO: 38683
  hemagglutinin__InfluenzaA__AFH74928

SEQ ID NO: 39258 - RNA, 1701 nt, Artificial Sequence; identical to SEQ ID NO: 38683
  hemagglutinin__InfluenzaA__AFH74939

SEQ ID NO: 39259 - RNA, 1701 nt, Artificial Sequence
  hemagglutinin__InfluenzaA__AFH74950
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacggcaacuguuacccuuaugaugugccggauuaugccucccuuaggucacuaguugccucauccggaacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39260 - RNA, 1701 nt, Artificial Sequence; identical to SEQ ID NO: 38676
  hemagglutinin__InfluenzaA__AFH74961

SEQ ID NO: 39261 - RNA, 1701 nt, Artificial Sequence; identical to SEQ ID NO: 38651
  hemagglutinin__InfluenzaA__AFH75388

SEQ ID NO: 39262 - RNA, 1701 nt, Artificial Sequence
  hemagglutinin__InfluenzaA__AFH97140
augaaggcaauacuaguaguucugcuauauauauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccuuccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguucugguagucucccugggggcaaucaguuucuggaugugcucuaaugggucucuacaguguagaauauguauuuaa

SEQ ID NO: 39263 - RNA, 1701 nt, Artificial Sequence
  hemagglutinin__InfluenzaA__AFJ05142
augaagacuaucauugcuuugagcuacauucuaugucugguuuucgcucaaaaaauuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuucggucacuaguugccucauccggcacacuggaguuuaacaaugaaugcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaauauuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuggaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39264 - RNA, 1701 nt, Artificial Sequence
  hemagglutinin__InfluenzaA__AFJ05144
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacguaacuaugccaaacaaugaacaauuugacaaauuauacauuugggggguucaccacccggguacggacaaggaccaaaucuuccuguaugcucaaucaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugggagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccucgagaaauauguggaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39265 - RNA, 1701 nt, Artificial Sequence
  hemagglutinin__InfluenzaA__AFJ11706
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguccagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccagauuaugccucccuuaggucacuaguugccucauccggcacacuggaguuuaacaaugaaagcuucaauuggacuggagucacucaaaacggcacaagcucugcuugcauaaggagcucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucaaauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39266 - RNA, 1701 nt, Artificial Sequence; identical to SEQ ID NO: 38854
  hemagglutinin__InfluenzaA__AFJ11728

SEQ ID NO: 39267 - RNA, 1701 nt, Artificial Sequence
  hemagglutinin__InfluenzaA__AFJ19842
augaagaccaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggaggucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaauugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39268 - RNA, 1701 nt, Artificial Sequence
  hemagglutinin__InfluenzaA__AFJ20171
augaagacuaucauugcuuugagcuacauucuaugucugguuucugcucaaaaacuuccuggaaaugacaacagcacggcaacgcugugccuugggcaccaugcagugccaaacggaacgauagugaaaacaaucacgaaugaccaaauugaaguuacuaaugcuacugagcuaguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaucaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcagguuucauagaaaaugguugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39269 - RNA, 1701 nt, Artificial Sequence
  hemagglutinin__InfluenzaA__AFJ20182
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacgcaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggaaggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaaacaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39270 - RNA, 1701 nt, Artificial Sequence
  hemagglutinin__InfluenzaA__AFJ74386
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacaccguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucugugaugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagaccaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccggagaaucaaaguuaaacagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 39271 - RNA, 1701 nt, Artificial Sequence
  hemagglutinin__InfluenzaA__AFJ74407
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaggugacuaaugcuacugagcugguucagaguuccucaacagguagaauaugcgacaguccucaccgaauccuugauggaaaaaacugcacacugauagaugcccuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaguucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgauuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39272 - RNA, 1701 nt, Artificial Sequence
  hemagglutinin__InfluenzaA__AFJ74418
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuguaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaaacaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39273 - RNA, 1701 nt, Artificial Sequence
  hemagglutinin__InfluenzaA__AFJ74437
augaagacuaucauugcuuugagcuacauuuuauguaagguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaacuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuguaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcagcugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39274 - RNA, 1701 nt, Artificial Sequence
  hemagglutinin__InfluenzaA__AFJ74448
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggaggcccucauugugauggcuuccaaaauaaggaaugggaccuuuuuguugaacgcagcaaagccuacagcaacuguuacccuuaugauguaccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauaugucaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaaaaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39275 - RNA, 1701 nt, Artificial Sequence
  hemagglutinin__InfluenzaA__AFJ74459
auggaagcaaaacuacuaguccuguugugugcauuuacagcuacauaugcagacacaauauguauaggcuaccaugcgaacaacucaacugacacuguugacacaguacuugagaagaacgugacagugacacacucugucaaccuacuugaggacagucacaacggaaaacuaugccgacuaaaaggaacagccccacuacaauuggguaauugcagcauugccggauggaucuuaggaaauccagaaugcgaaucacuguuuucuaaggaaucaugguccuacauugcagaaacaccaaacccugaaaauggaacauguuacccaggguauuucgccgacuaugaggaacugagggagcaauugagcucaguaucaucauucgagagauuugaaauauuccccaaggaaagcucauggcccaaccacaccguaaccaaaggagugacggcaucaugcucccauaaugggaaaagcagcuuuuacaaaaauuugcuauggcugacggagaagaauggcuuguacccaaaucugagcaaguccuauguaaacaacaaggaaaaagaaguccuugugcuaugggguguucaucacccgucuaacauaggggaccaaagggccaucuaucauacagaaaaugcuuaugucucuguagugucuucacauuauagcagaagauucaccccagaaauagcaaaaagacccaaaguaagaaaucaagaagggagaauuaacuacuacuggacucugcuggaacccggggacacaauaauauuugaggcaaauggaaaucuaauagcgccaugguacgcuuucgcauugaguagagguuuugggucaggaaucaucaccucaaacgcaucaaugggugaaugugacgcuaagugucaaacaccccaaggagcuauaaacaguagucuuccuuuccagaauguacacccagucacaauaggggaguguccaaaguaugucaggaguacaaaauuaaggaugguuacaggacuaaggaacaucccauccauucaauccagagguuuguuuggagccauugccgguuucauugaaggaggguggacuggaaugauagauggaugguaugguuaucaucaucagaaugaacaaggaucuggcuaugcugcggaccaaaaaagcacacaaaaugccauuaaugggauuacaaacaaggugaauucuauaaucgagaaaaugaacacucaauucacagcuguaggcaaagaauucaacaaauuagaaagaaggauggagaacuuaaauaagaaaguugaugauggauuucuggacauuuggacauacaaugcagaauuguugguucuccuggaaaaugaaaggacuuuggauuuucaugacucaaaugugaagaaccuguaugagaaaguaaaaaaccaacugaagaauaaugccaaagaaauaggaaacggguguuuugaauucuaucacaaguguaacaaugaaugcauggaaagugugaaaaauggaacuuaugacuauccaaaauauuccaaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcaucuga

SEQ ID NO: 39276 - RNA, 1701 nt, Artificial Sequence
  hemagglutinin__InfluenzaA__AFJ74470
augaagacuaucauugcuuuaagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaucagccuauaugcucaaacaucagggagagucacagucucuaccaaaagaagccaacaaacuguaaucccgaauaucggaucaagacccuggguaagggguguuuccagcagaauaagcaucuauuggacaauaguaaagccgggagacauacuuuugauuaacagcacagggaaucuaauugcuccucgggguuacuucaaaauacgaagugggaaaagcucaauaaugaggucagaugcacccauuggcaacugcaguucugaaugcaucacuccaaauggaagcauucccaaugacaaaccauuucaaaauguaaacaggaucacauauggggccugucccagauauguuaagcaaaacacucugaaacuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguugaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuauaaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39277 - RNA, 1701 nt, Artificial Sequence
  hemagglutinin__InfluenzaA__AFJ74492
augaagacuaucauugcuuugagcuacauuuuaugucugguuuucgcucaaaaacuucccggaaaugacaacagcacggcaacgcugugccuggggcaccaugcaguaccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaauaaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuucaaaauacgaaaugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguuccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgggaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguucaagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39278 - RNA, 1701 nt, Artificial Sequence
  hemagglutinin__InfluenzaA__AFJ74525
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucaggauggaacaagcucugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggaccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39279 - RNA, 1701 nt, Artificial Sequence
  hemagglutinin__InfluenzaA__AFJ74535
augaagacuaucauugcuuugagcuacauuuuaugucugguuuucgcucaaaaacuucccggaaaugacaacagcacggcaacgcugugccuggggcaccaugcaguaccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaauaaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuucaaaauacgaaaugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgggaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguucaagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39280 - RNA, 1701 nt, Artificial Sequence
  hemagglutinin__InfluenzaA__AFJ74560
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaucaaauugaagugacuaaugcuacugagcugguucagaguuccucaacagguagaauaugcgacaguccucaccaaauccuugauggagaaaacuguacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaaacaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuauuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuagucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 39281 - RNA, 1701 nt, Artificial Sequence
  hemagglutinin__InfluenzaA__AFJ74634
augaagacuaucauugcuuugagcuacauucuaugucugguuuucgcccaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccaauuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39282 - RNA, 1698 nt, Artificial Sequence
  hemagglutinin__InfluenzaA__AFJ74653
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaacuaugucuauuaaaaggaauagccccacuacaauuggguaauugcagcguugccggguggauauuaggaaacccagaaugcgaauuacugauuuccaaggaaucaugguccuacauuguagaaaaaccaaauccugagaauggaacauguuacccaggguauuucgcugacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaacuugagcaaguccuaugcaaacaacaaagagaaagaaguccuuguacuaugggguguucaucacccuccuaacauaggugaccaaagggcccucuaucauacagacaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauccaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaauuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39283 - RNA, 1698 nt, Artificial Sequence
  hemagglutinin__InfluenzaA__AFJ74673
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaacuaugucuauuaaaaggaauagccccacuacaauuggguaauugcagcguugccggguggauauuaggaaacccagaaugcgaauuacugauuuccaaggaaucaugguccuacauuguagaaaaaccaaauccugagaauggaacauguuacccaggguauuucgcugacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaacuugagaaaguccuaugcaaacaacaaagagaaagaaguccuuguacuaugggguguucaucacccuccuaacauaggugaccaaagggcccucuaucauacagacaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauccaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaauuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39284 - RNA, 1701 nt, Artificial Sequence
  hemagglutinin__InfluenzaA__AFJ74674
augaagacuaucauugcuuugagcuacauuuuaugucugguguucgcucaaaaacuucccggaaaugacaacagcacggcaacgcugugccuugggcaccaugcaguaccaaacggaacgcuagugaaaacaaucacgaaugaccaaauugaagugacuaaugcuacugagcugguucagaguuccucaacagguggaauaugugacaguccucaucagauccuugauggagaaaacugcacacuaauagaugcucuauugggagacccucauugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcauugaacgugacuaugccaaacaaugaaaaauuugacaaauuauacauuugggggguucaccacccggguacggacagugaccaaaucagccuauaugcucaagcgucagggagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggagaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaccuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaaugggaaauugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuugcugggguucaucaugugggccugccaaaaaggcaacauuaggugcaacauuugcauuuga

SEQ ID NO: 39285 - RNA, 1698 nt, Artificial Sequence; identical to SEQ ID NO: 39282
  hemagglutinin__InfluenzaA__AFJ74694

SEQ ID NO: 39286 - RNA, 1701 nt, Artificial Sequence
  hemagglutinin__InfluenzaA__AFJ74695
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaauuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguucaacaaugaaagcuucaauuggacuggagucgcucaggauggaacaagcucugcuuguaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucgagcaucagggagagucacagucucuaccaaaagaagccaacaaacuguaaucccgaauauuggaucuagacccuggguaaggggugucuccagcaaaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaaugggagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugguggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 39287 - RNA, 1701 nt, Artificial Sequence
  hemagglutinin__InfluenzaA__AFJ74727
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccaauuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaguggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39288 - RNA, 1698 nt, Artificial Sequence; identical to SEQ ID NO: 39282
  hemagglutinin__InfluenzaA__AFJ74743

SEQ ID NO: 39289 - RNA, 1701 nt, Artificial Sequence
  hemagglutinin__InfluenzaA__AFJ74744
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuacgccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccaauuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39290 - RNA, 1698 nt, Artificial Sequence
  hemagglutinin__InfluenzaA__AFJ74760
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaacuaugucuauuaaaaggaauagccccacuacaauuggguaauugcagcguugccggguggauauuaggaaacccagaaugcgaauuacugauuuccaaggaaucaugguccuacauuguagaaaaaccaaauccugagaauggaacauguuacccaggguauuucgcugacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaacuugagcaaguccuaugcaaacaacaaagagaaagaaguccuuguacuaugggguguucaucacccuccuaacauaggugaccaaagggcccucuaucauacagacaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauccaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaagugcaacgaugaaugcauggagaguguaaaaaauggaaccuaugacuauccaaaauauuccgaagaaucaaaauuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39291 - RNA, 1701 nt, Artificial Sequence
  hemagglutinin__InfluenzaA__AFJ74761
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccaauuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacggagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39292 - RNA, 1698 nt, Artificial Sequence; identical to SEQ ID NO: 39282
  hemagglutinin__InfluenzaA__AFJ74779

SEQ ID NO: 39293 - RNA, 1701 nt, Artificial Sequence
  hemagglutinin__InfluenzaA__AFJ74780
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuacgaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccaauuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaccaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39294 - RNA, 1701 nt, Artificial Sequence
  hemagglutinin__InfluenzaA__AFJ74804
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaggaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauagcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39295 - RNA, 1701 nt, Artificial Sequence
  hemagglutinin__InfluenzaA__AFJ74819
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucaaccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauagcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39296 - RNA, 1701 nt, Artificial Sequence
  hemagglutinin__InfluenzaA__AFJ74842
augaagacuaucauugcuuugagcuacauccuaugucugguuuucgcucaaaaacuucccggaaaugacaacagcacggcaacgcugugccuugggcaucaugcaguaccaaacggaacgauagugaaaacaauaacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucuucuugcaaaaggagaucuaauaacaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccggauaagcaucuauuggacaauaguaaaaccgggagacauacuucugauuaacagcacagggaaucuaauagcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaaugugccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaauagggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39297 - RNA, 1698 nt, Artificial Sequence
  hemagglutinin__InfluenzaA__AFJ75036
augaaaguaaaacuacugguccuguuaugcacauuuacagcuacauaugcagacacaauauguauaggcuaucaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugagagguucgaaauauuccccaaagaaaacucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39298 - RNA, 1701 nt, Artificial Sequence
  hemagglutinin__InfluenzaA__AFJ75047
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacccaaaauggaacaagcucugcuugcaaaaggagaucuaauaacagcuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggaggggaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaucacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39299 - RNA, 1698 nt, Artificial Sequence
  hemagglutinin__InfluenzaA__AFJ75058
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39300 - RNA, 1698 nt, Artificial Sequence
  hemagglutinin__InfluenzaA__AFJ75069
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaucaaauccugagaauggaacauguuacccagggcauuucgccgacuaugaggaacugagggagcaauugaguucaguaucuucauuugagagauucgaaauauuccccaaagaaagcucauggcccaaccacaccacaaccggaguaucagcaucaugcucccauaauggggaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaagggcucucuaucauacagaaaaugcuuaugucucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccugucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39301 - RNA, 1701 nt, Artificial Sequence
  hemagglutinin__InfluenzaA__AFJ75091
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacagacaaugaccaaaucuuccuguaugcucaagcaucaggaagaaucacagucucuaccaaaauaagucaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaccaaaauucugagggaauaggacaagcagcagaucucaaaagcacucaagcagcaaucgaucaaaucaaugggaagcugaauagguugaucgggaaaaccaaugagaaauuccaucagauugaaaaagaauucucagaaguagaagggagaauucaggaccucgagaaauauguugaggacacuaaaauagaucucuggucauacaacgcggaucuucuuguugcccuggagaaccaacauacaauugauuuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39302 - RNA, 1701 nt, Artificial Sequence
  hemagglutinin__InfluenzaA__AFJ75449
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaaaaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggaaggaaugguggaugguugguacgguuucaggcaucaaaauucugagggaacaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39303 - RNA, 1701 nt, Artificial Sequence
  hemagglutinin__InfluenzaA__AFJ75460
augaagacuaucauugcuuugagcuacauucuaugucugguuuucacucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcagucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgauuccagaucaagggaguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39304 - RNA, 1698 nt, Artificial Sequence
  hemagglutinin__InfluenzaA__AFJ75517
augaaaguaaaacuacugguccuauuaugcacauuuacagcuacauaugcagacacaauauguaucggcuaccaugccaacaacucaaccgacacuguugacacaguacuugaaaagaaugugacagugacauacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaagaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaacggggaaagcagcuuuuacaaaaauuugcuauggcugacgggaaagaaugguuuguacccaaaccugagcaaguccuaugcaaacaacaaagagaaagaaguccucguacuaugggguguucaucacccgccaaacauaggugaccaaaugacccucuaucauaaaaaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaaugggaaucuaauagcaccaagauaugcuuucgcacugaauagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaacucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugaaaggacuuuggauuuccaugacuccaaugugaagaauuuguaugagaaaguaaaaacccaauuaaagaauaaugccaaagaaauaggaaauggguguuuugaauuuuaucacaaguguaacgaugaaugcauggagaguguaaaaaauggaacuuaugauuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39305 - RNA, 1698 nt, Artificial Sequence
  hemagglutinin__InfluenzaA__AFJ75560
augaaaguaaaacuacugguccuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaagaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaacggggaaagcagcuuuuacaaaaauuugcuauggcugacgggaaagaaugguuuguacccaaaccugagcaaguccuaugcaaacaacaaagagaaagaaguccucguacuaugggguguucaucacccgccaaacauaggugaccaaaugacccucuaucauaaagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaaugggaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguuugucaggagugcaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaacucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugaaaggacuuuggauuuccaugacuccaauguaaagaauuuguaugagaaaguaaaaaaccaauuaaggaauaaugccaaagaaauaggaaauggguguuuugaauuuuaucacaaguguaacgaugaaugcauggagaguguaaaaaauggaacuuaugauuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39306 - RNA, 1698 nt, Artificial Sequence
  hemagglutinin__InfluenzaA__AFJ75571
augaaaguaaaacuacugguccuauuaugcacauuuacagcuacauaugcagacacaauauguaucggcuaccaugccaacaacucaaccgacacuguugacacaguacuugaaaagaaugugacagugacacauucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaagaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaacggggaaaacagcuuuuacaaaaauuugcuauggcugacgggaaagaaugguuuguacccaaaccugagcaaguccuaugcaaacaacaaagagaaagaaguccucguacuaugggguguucaccacccgccaaacauaggugaccaaaugacccucuaucauaaagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaaugggaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaacucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugaaaggacuuuggauuuccaugacuccaaugugaagaauuuguaugagaaaguaaaaaaccaauuaaagaauaaugccaaagaaauaggaaauggguguuuugaauuuuaucacaaguguaacgaugaaugcauggagaguguaaaaaauggaacuuaugauuauccaaaauauuccgaagaaucaaaguuaagcagggagagaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39307 - RNA, 1701 nt, Artificial Sequence
  hemagglutinin__InfluenzaA__AFJ75593
augaagacuaucauugcucugagcuacauucuaugucugguuuucgcucaaaaacuuccuggaaaugacagcagcacggcaacgcugugccuugggcaccaugcaguaccaaacggaacaauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauauccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauauggggccugucccagauauguuaagcaaaacacucugaaauuggcaacagggaugcgaaauguaccagaaaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaguagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaauaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39308 - RNA, 1698 nt, Artificial Sequence
  hemagglutinin__InfluenzaA__AFJ75615
augaaaguaaaacuacugguccuguuaugcacauuuacagcuacauaugcagacacaauauguguaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguggugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacuauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagaagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39309 - RNA, 1701 nt, Artificial Sequence
  hemagglutinin__InfluenzaA__AFJ75630
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguaugguuucaggcaucaaaauucugagggaagaggacaagcagcagaucucaaaagcacucaagcagcaaucgaucaaaucaaugggaagcugaauagauugaucgggaaaaccaacgagaaauuccaucaaauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39310 - RNA, 1701 nt, Artificial Sequence
  hemagglutinin__InfluenzaA__AFJ75641
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucggaaaaaccaacgagaaauuccaucagauugaaaaagaauucucagaagucgaagggagaauucaggaccuugagaaauauguugaggacaccaaaauagaucucuggucauacaacgcggagcuucuuguugcacuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39311 - RNA, 1698 nt, Artificial Sequence
  hemagglutinin__InfluenzaA__AFJ75651
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucguacagaaaaugcuuauguuucuguagugucuucacauuacagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucagaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucgaugggagucuaucagauucuggcgaucuacucaacagucgccaguucucugguucuuuuggucucccugggggcaaucagcuucuggauguguuccaaugggucuuugcaauguagaauaugcaucuaa

SEQ ID NO: 39312 - RNA, 1701 nt, Artificial Sequence
  hemagglutinin__InfluenzaA__AFJ75662
augaagacuaucauugcuuugagcuacauucuauguuugguuuucgcucaaaaacuuccuggaaaugacaacagcacggcaacacugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaacaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauauuggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguaugguuucaggcaucaaaauucugagggaacaggacaagcagcagaucucaaaagcacucaagcagcaaucgaucaaaucaaugggaagcugaauagguugauaggaaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaauggcuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39313 - RNA, 1698 nt, Artificial Sequence
  hemagglutinin__InfluenzaA__AFJ75673
augaaaguaaaacuacugguccuauuaugcacauuuacagcuacauaugcagacacaauauguaucggcuaccaugccaacaacucaaccgacacuguugacacaguacuugaaaagaaugugacagugacauacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaagaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaacggggaaagcagcuuuuacaaaaauuugcuauggcugacgggaaagaaugguuuguacccaaaccugagcaaguccuaugcaaacaacaaagagaaagaaguccucguacuaugggguguucaucacccgccaaacauagguaaccaaaugacccucuaucauaaagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaaugggaaucuaauagcaccaagauaugcuuucgcacugaauagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaacucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugaaaggacuuuggauuuccaugacuccaaugugaagaauuuguaugagaaaguaaaaacccaauuaaagaauaaugccaaagaaauaggaaauggguguuuugaauuuuaucacaaguguaacgaugaaugcauggagaguguaaaaaauggaacuuaugauuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39314 - RNA, 1701 nt, Artificial Sequence; identical to SEQ ID NO: 33173
  hemagglutinin__InfluenzaA__AFJ76119

SEQ ID NO: 39315 - RNA, 1701 nt, Artificial Sequence
  hemagglutinin__InfluenzaA__AFJ76131
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacaugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39316 - RNA, 1701 nt, Artificial Sequence
  hemagglutinin__InfluenzaA__AFJ76155
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaagcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39317 - RNA, 1698 nt, Artificial Sequence
  hemagglutinin__InfluenzaA__AFJ76186
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauaaccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucagaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaacgggucuuugcaauguagaauaugcaucuaa

SEQ ID NO: 39318 - RNA, 1701 nt, Artificial Sequence
  hemagglutinin__InfluenzaA__AFJ76203
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggauauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39319 - RNA, 1701 nt, Artificial Sequence
  hemagglutinin__InfluenzaA__AFJ76213
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaacaaaaguuucuuuaguagauugaauugguugacccacucaaaauacaaauacccagcauugaacgugacuaugccaaacaaugaaaaauuugacaaauuguacaucugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauagcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39320 - RNA, 1701 nt, Artificial Sequence
  hemagglutinin__InfluenzaA__AFJ77408
augaagacuaucauugcuuugagcuacauuuuaugucugauuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcaacaguccucaccgaauccuugauggagaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaggaaggcuucaauuggacuggagucgcucaggaugggaaaagcuauucuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucggggagagucacagucucuaccaaaagaagccaacaaacuguaaucccgaauaucgggucuagacccuggguaagggguaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaguuggcaacagggaugcggaaugugccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgaaaaauuccaucaaaucgaaaaagaauucucagaaguagaagggagaauucaggaccuugagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39321 - RNA, 1701 nt, Artificial Sequence
  hemagglutinin__InfluenzaA__AFJ77430
augaagacuaucauugcuuugagcuacauuuuaugucugauuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggagaaaacugcacacugauagaugcucuauugggagacccuaauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaggaaggcuucaauuggacuggagucgcucaggaugggaaaagcuauucuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggacagugaccaaaucagccuauaugcucaagcaucggggagagucacagucucuaccaaaagaagccaacaaacuguaaucccgaauaucgggucuagacccuggguaagggguaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaguuggcaacagggaugcggaaugugccagagaaacaaacuagaggcauauucggcgcaaucgcagguuucauagaaaaugguugggagggaaugguagacgguugguaugguuucaggcaucaaaauucugagggcacaggacaagcagcagaucuuaaaagcacucaagcagcaaucaaccaaaucaacgggaaacugaauagguuaaucgagaaaacgaacgaaaaauuccaucaaaucgaaaaagaauucucagaaguagaagggagaauucaggaccuugagaaauauguugaagacacuaaaauagaucucuggucuuacaacgcggagcuucuuguugcccuggagaaccaacauacaauugaucuaacugacucagaaaugaacaaacuguuugaaagaacaaggaggcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39322 - RNA, 1701 nt, Artificial Sequence
  hemagglutinin__InfluenzaA__AFJ77440
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaggugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaccagugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgauuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39323 - RNA, 1701 nt, Artificial Sequence
  hemagglutinin__InfluenzaA__AFJ77451
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaaguggaaaaagcucaauaaugaggucagaugcacccauuggcaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgggaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39324 - RNA, 1701 nt, Artificial Sequence
  hemagglutinin__InfluenzaA__AFJ77462
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39325 - RNA, 1701 nt, Artificial Sequence
  hemagglutinin__InfluenzaA__AFJ77473
augaagacuaucauugcuuugagcuacauuuuaugucagguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaacuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuguaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcagcugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39326 - RNA, 1701 nt, Artificial Sequence
  hemagglutinin__InfluenzaA__AFJ77484
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugagcgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39327 - RNA, 1701 nt, Artificial Sequence; identical to SEQ ID NO: 30692
  hemagglutinin__InfluenzaA__AFJ77495

SEQ ID NO: 39328 - RNA, 1701 nt, Artificial Sequence
  hemagglutinin__InfluenzaA__AFJ77506
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccccaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39329 - RNA, 1701 nt, Artificial Sequence
  hemagglutinin__InfluenzaA__AFJ77517
augaagacuaucauugcuuugagcuacauucuaugucugguuuucgcucaaaaaauucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcaaugcuugcaaaaggagaucuaugaaaaguuucuuuaguagauugaauugguugcaccaauugaaauacaaauauccagcacugaacgugacuaugccaaacaaugauaaauuugacaaauuguacauuugggggguucaccacccgaguacggacagugaccaaaccagccuauaugcucaagcaucagggagagucacagucucuacccaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaauaaggucagaugcacccauuggaaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugaaggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccaugucauguuuuuugcuuuguguuguuuugcugggguucaucaugugggccugccaaaaaggcaacauuaggugcaacauuugcauuuga

SEQ ID NO: 39330 - RNA, 1701 nt, Artificial Sequence
  hemagglutinin__InfluenzaA__AFJ77528
augaagacuaucauugcuuugagcuacauuuuaugucugguuuucgcccaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggaaaaaacugcacacugauagaugcucuauugggagacccucauugugauggcuuccaaaauaaggaaugggaccuuuuuguugaacgcagcacagcuuacagcaacuguuacccuuaugaugugccggauuaugccucccuuaggucacuaguugccucauccggcacccuggaguuuaccaaagaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucggaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaagaaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugaguugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39331 - RNA, 1698 nt, Artificial Sequence
  hemagglutinin__InfluenzaA__AFJ77550
augaagacuaucauugcuuugagcuacauuuuaugucagguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacggguagaauaugcgacaguccucaccaaauccuugauggagaaaacugcacacuaauagaugcucuauugggagacccucauugugauggcuuccaaaauaaggaaugggaccuuuuuguugaacgcagcaaagcauacagcaacuguuacccuuaugaugugccggauuaugccucccuuaggucacuaguugccucauccggcacacuggaguuuaacaaugaaagcuucaacuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuguaugcucaagcaucagggagagucacagucucuaccaaaagaagccaacaaacuguaaucccaaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcagcugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcagcauuugcauuuga

SEQ ID NO: 39332 - RNA, 1701 nt, Artificial Sequence
  hemagglutinin__InfluenzaA__AFJ77561
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucaagacccuggguaagggguguuuccagcagaauaagcaucuauuggacaauaguaaagccgggagacauacuuuugauuuacagcacagggaaucuaauugcuccucgggguuacuucaaaauacgaagugggaaaagcucaauaaugaggucagaugcacccauuggcaacugcaguucugaaugcaucacuccaaauggaagcauucccaaugacaaaccauuucaaaauguaaacaggaucacauauggggccugucccagauauguuaagcaaaacacucugaaacuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguugaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39333 - RNA, 1698 nt, Artificial Sequence
  hemagglutinin__InfluenzaA__AFJ77572
augaagacuaucauugcuuugagcuacauuuuaugucagguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacggguagaauaugcgacaguccucaccaaauccuugauggagaaaacugcacacuaauagaugcucuauugggagacccucauugugauggcuuccaaaauaaggaaugggaccuuuuuguugaacgcagcaaagcauacagcaacuguuacccuuaugaugugccggauuaugccucccuuaggucacuaguugccucauccggcacacuggaguuuaacaaugaaagcuucaacuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuguaugcucaagcaucagggagagucacagucucuaccaaaagaagccaacaaacuguaaucccaaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcagcugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcagcauuugcauuuga

SEQ ID NO: 39334 - RNA, 1701 nt, Artificial Sequence
  hemagglutinin__InfluenzaA__AFJ77583
augaagacuaucauuacuuugagcuacauuuuaugucugguuuucgcucaaaaacuucccguaaaggacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggacuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccuguccuagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39335 - RNA, 1701 nt, Artificial Sequence
  hemagglutinin__InfluenzaA__AFJ77594
augaagacuaucauugcuuugagcuacauuuuaugucugguuuucgcucaaaaacuucccguaaaggacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcugagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39336 - RNA, 1701 nt, Artificial Sequence
  hemagglutinin__InfluenzaA__AFJ77605
augaaaacuaucauugcuuugagcuacauuuuaugucugauuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguaaaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugaccaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaggggaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcaguaaacaaucgguuucagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39337 - RNA, 1701 nt, Artificial Sequence
  hemagglutinin__InfluenzaA__AFJ77616
augaagacuaucauugcuuugagcuacauuuuauguaugguucucgcucaaaaacuucccguaaaggacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcgggcuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39338 - RNA, 1701 nt, Artificial Sequence
  hemagglutinin__InfluenzaA__AFJ77627
augaagacuaucauugcuuugagcuacauuuuaugucugguucucgcucaaaaacuucccguaaaggacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaggaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39339 - RNA, 1701 nt, Artificial Sequence
  hemagglutinin__InfluenzaA__AFJ77638
augaagacuaucauugcuuugagcuacauuuuaugucugguuuucgcucaaaaacuucccggaaaugacaacagcacggcaacgcugugccuggggcaccaugcaguaccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuauacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaccacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaauggaugggagggaaugguggacgguugguacgguuucaggcaucaaaauucugagggcacaggacaagcagcagaucuuaaaagcacucaagcagcaaucaaccaaaucaacgggaaacugaauagguuaaucgggaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39340 - RNA, 1701 nt, Artificial Sequence
  hemagglutinin__InfluenzaA__AFJ77649
augaagacuaucauugcuuugagcuacauuuuaugucugguuuucgcucaaaaacuucccggaaaugacaacagcacggcaacgcugugccuggggcaccaugcaguaccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggaguagcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacaacacagggaaucuaauugcuccucgggguuacuucaaaauacgaaaugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgggaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguucaagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39341 - RNA, 1701 nt, Artificial Sequence
  hemagglutinin__InfluenzaA__AFJ77660
augaagacuaucauugcuuugagcuacauuuuaugucugguuuucgcucaaaaacuucccggaaaugacaacagcacggcaacgcugugccuaggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaaaaguuucuuuaguagauuaaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39342 - RNA, 1701 nt, Artificial Sequence
  hemagglutinin__InfluenzaA__AFJ77671
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39343 - RNA, 1701 nt, Artificial Sequence
  hemagglutinin__InfluenzaA__AFJ77682
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggugucgcucagaauggaacaagcucugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcgaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39344 - RNA, 1701 nt, Artificial Sequence
  hemagglutinin__InfluenzaA__AFJ77693
augaagacuaucauugcuuugagcuacauuuuaugucugguuuucgcucaaaaacuucccguaaaugacaacagcacggcaacgcugugccugggacaccauacagugccaaacggaacgcuagugaaaacaaucacgaaugacaacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaacgaaagcuucaauuggacuggagucgaucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggaaaaugcaauucugaaugcaucacuccaaauggaagcauucccaaugacaaaccauuucaaaauguaaacaggaucacauauggggccugucccagauauguuaaacaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauuuugagggcacaggacaagcagcagaucuuaaaagcacucaagcagcaaucaaccaaaucaacgggaaacugaauagguuaauugagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguucgaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuaa

SEQ ID NO: 39345 - RNA, 1701 nt, Artificial Sequence; identical to SEQ ID NO: 39342
  hemagglutinin__InfluenzaA__AFJ77704

SEQ ID NO: 39346 - RNA, 1701 nt, Artificial Sequence
  hemagglutinin__InfluenzaA__AFJ77715
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugacaacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaacgaaagcuucaauuggacuggagucgaucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggaaaaugcaauucugaaugcaucacuccaaauggaagcauucccaaugacaaaccauuucaaaauguaaacaggaucacauauggggccugucccagauauguuaaacaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguucgaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuaa

SEQ ID NO: 39347 - RNA, 1701 nt, Artificial Sequence; identical to SEQ ID NO: 39346
  hemagglutinin__InfluenzaA__AFJ77726

SEQ ID NO: 39348 - RNA, 1701 nt, Artificial Sequence
  hemagglutinin__InfluenzaA__AFJ77737
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccaauuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39349 - RNA, 1701 nt, Artificial Sequence
  hemagglutinin__InfluenzaA__AFJ77748
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaauuagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguggaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39350 - RNA, 1701 nt, Artificial Sequence; identical to SEQ ID NO: 31253
  hemagglutinin__InfluenzaA__AFJ77759

SEQ ID NO: 39351 - RNA, 1701 nt, Artificial Sequence
  hemagglutinin__InfluenzaA__AFJ77781
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacagugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauagcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaagugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39352 - RNA, 1701 nt, Artificial Sequence
  hemagglutinin__InfluenzaA__AFJ77792
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39353 - RNA, 1701 nt, Artificial Sequence
  hemagglutinin__InfluenzaA__AFJ77803
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaacguaccagagaaacaaacuagaggcauauuuggcgcaaucgcagguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39354 - RNA, 1701 nt, Artificial Sequence; identical to SEQ ID NO: 38456
  hemagglutinin__InfluenzaA__AFJ77814

SEQ ID NO: 39355 - RNA, 1701 nt, Artificial Sequence
  hemagglutinin__InfluenzaA__AFJ77825
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaggccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaacguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39356 - RNA, 1701 nt, Artificial Sequence
  hemagglutinin__InfluenzaA__AFJ77836
augaagacuaucauugcuuugagcuacauucuaugucuaguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguccaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaacguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39357 - RNA, 1701 nt, Artificial Sequence
  hemagglutinin__InfluenzaA__AFJ77847
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaacguaaacaggaucacauauggggccugucccagauauguuaagcaaaacacucugaaauuggcaacagggaugcgaaacguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39358 - RNA, 1701 nt, Artificial Sequence
  hemagglutinin__InfluenzaA__AFJ77858
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuacccaaagaagccaacaaacuguaaucccgaauaucggaucuagacccaggguaagggauauccccagcagaauaagcaucuauuggacaauaguaaaaccgggagacaugcuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaccaaaucaaugggaagcugaauaaguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuuguuuuguguugcuuuguugggguucaucaugugggccugccaaaaaggcaacauuaggugcaacauuugcauuuga

SEQ ID NO: 39359 - RNA, 1701 nt, Artificial Sequence
  hemagglutinin__InfluenzaA__AFJ77869
augaagacuaucauugcuuuuagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagggaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39360 - RNA, 1701 nt, Artificial Sequence
  hemagglutinin__InfluenzaA__AFJ77880
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacaaaugaccaaauugaaguuacuaaugcuacugagcugguucagaguuccucaacaggaggaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaaguucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaacguaaacaggaucacauauggggccugucccagauauguuaagcaaaacacucugaaauuggcaacagggaugcgaaacguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaucacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuucuugcuuuguguugcuuuguugggguucaucaugugggccugccaaaaaggcaacauuaggugcaacauuugcauuuga

SEQ ID NO: 39361 - RNA, 1701 nt, Artificial Sequence
  hemagglutinin__InfluenzaA__AFJ77902
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucauuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucggccuauaugcucaagcaucaggaagaaucacagucucuaccaaaagaagccaacaaacuguaaucccgaauaucggaucuagacccaggguaagggauauccccagcagaauaagcauuuauuggacaauaguaaaaccgggagacaugcuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucuuuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39362 - RNA, 1701 nt, Artificial Sequence
  hemagglutinin__InfluenzaA__AFJ77913
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugcaggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacaugcuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgauuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39363 - RNA, 1701 nt, Artificial Sequence
  hemagglutinin__InfluenzaA__AFJ77924
augaagacuaucauugcuuugagcuacauucuaugucugguuuucgcucaaaaacuucccggaaaugacaacagcacggcaacgcugugccuugggcaccaugcaguaccaaacggaacgguagugaaaacaaucacaaaugaccaaauugaaguuacuaaugcuacugagcugguucagaguuccucaacagguggaauaugcgacaguccucaucagauccuugauggagaaaacugcacacuaauggaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggaauauuuggcgcaaucgcggguuucauagaaaaugguugggagggaaugguggaugguugguacgguuucaggcaucaaaauucugagggaacaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaaaaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39364 - RNA, 1701 nt, Artificial Sequence
  hemagglutinin__InfluenzaA__AFJ77935
augaagacuaucauugcuuugagcuacauucuaugucugguuuucgcucaaaaacuucccggaaaugacaacagcacggcaacgcugugccuugggcaccaugcaguaccaaacggaacgguagugaaaacaaucacaaaugaccaaauugaaguuacuaaugcuacugagcugguucagaguuccucaacagguggaauaugcgacaguccucaucagauccuugauggagaaaacugcacacuaauggaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaacauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggaaaaccaacauacaauugaucuaacugacucagaaaugaacaaacuguuugaaagaacaaaaaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39365 - RNA, 1701 nt, Artificial Sequence
  hemagglutinin__InfluenzaA__AFJ77946
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccucaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacaugcuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauauuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugaaggaacaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggaucauauggauuuccuuugccauaucauguuuuuugcuuuguguugcuuuguugggguucaucaugugggccugccaaaaaggcaacauuaggugcaacauuugcauuuga

SEQ ID NO: 39366 - RNA, 1701 nt, Artificial Sequence
  hemagglutinin__InfluenzaA__AFJ77957
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacagacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39367 - RNA, 1701 nt, Artificial Sequence; identical to SEQ ID NO: 31139
  hemagglutinin__InfluenzaA__AFJ77968

SEQ ID NO: 39368 - RNA, 1701 nt, Artificial Sequence
  hemagglutinin__InfluenzaA__AFJ77979
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaggucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39369 - RNA, 1701 nt, Artificial Sequence
  hemagglutinin__InfluenzaA__AFJ77990
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucuuccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugaugaauacagagaugaagcauuaaacaaccgguuccagaucaaaggcguugagcugaagucaggauacaaagauuggauccuauggauuuccuuugccauaucauguuuuuugcuuuguguuacuuuguugggguucaucaugugggccugccaaaaaggcaacauuaggugcaacauuugcauuuga

SEQ ID NO: 39370 - RNA, 1701 nt, Artificial Sequence
  hemagglutinin__InfluenzaA__AFJ78001
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggaaaaaacugcacacuaauagaugcucuauugggagacccucagugugaugacuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccaggguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguuacuuuguugggguucaucaugugggccugccaaaaaggcaacauuaggugcaacauuugcauuuga

SEQ ID NO: 39371 - RNA, 1701 nt, Artificial Sequence
  hemagglutinin__InfluenzaA__AFJ78012
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagcccacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39372 - RNA, 1701 nt, Artificial Sequence
  hemagglutinin__InfluenzaA__AFJ78023
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaucaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggaaaucuaauaacaguuucuuuaguagauugaauugguugacccacuuaaaauucaaauacccagcauugaacgugacuaugccaaacaaugaaaaauuugacaaauuguacauuugggggguucaccacccggguacagacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucggaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaacguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39373 - RNA, 1701 nt, Artificial Sequence
  hemagglutinin__InfluenzaA__AFJ78034
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaucaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacagacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucggaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaacguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39374 - RNA, 1701 nt, Artificial Sequence
  hemagglutinin__InfluenzaA__AFJ78045
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcagagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuaggcccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaaugggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcuuuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaagugcaacauuugcauuuga

SEQ ID NO: 39375 - RNA, 1701 nt, Artificial Sequence; identical to SEQ ID NO: 31139
  hemagglutinin__InfluenzaA__AFJ78056

SEQ ID NO: 39376 - RNA, 1701 nt, Artificial Sequence
  hemagglutinin__InfluenzaA__AFJ78067
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaauugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggagaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauagggcaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggcuacaaagauuggauccuauggauuuccuuugccauaucauguuuuuugcuuuguguugcuuuguugggguucaucaugugggccugccaaaaaggcaacauuaggugcaacauuugcauuuaa

SEQ ID NO: 39377 - RNA, 1701 nt, Artificial Sequence
  hemagglutinin__InfluenzaA__AFJ78078
augaagacuaucauugcuuugagcuacauucuaugucugguuuucgcucaaaaacuucccggaaaugacaacagcacggcaacgcugugccuugggcaccaugcaguaccaaauggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacagacaaugaccaaaucuuccuguaugcucaagcaucaggaagaaucacagucucuaccaaaagaagucaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauugacaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaaugagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugauuuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgcuuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39378 - RNA, 1701 nt, Artificial Sequence; identical to SEQ ID NO: 39301
  hemagglutinin__InfluenzaA__AFJ78089

SEQ ID NO: 39379 - RNA, 1701 nt, Artificial Sequence
  hemagglutinin__InfluenzaA__AFJ78100
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacagacaaugaccaaaucuuccuguaugcucaagcaucaggaagaaucacagucucuaccaaaagaagucaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagauugaucgggaaaaccaaugagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugauuuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuugcugggguucaucaugugggccugccaaaaaggcaacauuaggugcaacauuugcauuuga

SEQ ID NO: 39380 - RNA, 1701 nt, Artificial Sequence
  hemagglutinin__InfluenzaA__AFJ78111
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacucuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauugaacgugacuaugccaaacaaugaaaacuuugacaaauuguacauuugggggguucaccacccggguacagacaaugaccaaaucuuccuguaugcucaagcaucaggaagaaucacagucucuaccaaaagaagucaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaauagcggguuucauagaaaaugguugggagggaaugguggaugguugguacgguuucagacaucaaaauucugagggaauaggacaagcagcagaucucaaaagcacucaagcagcaaucgaucaaaucaaugggaagcugaauagguugaucgggaaaaccaaugagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugauuuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39381 - RNA, 1701 nt, Artificial Sequence
  hemagglutinin__InfluenzaA__AFJ78122
augaagacuaucauugcuuugagcuacauucuaugucugauuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgauaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacagacaaugaccaaaucuuccuguaugcucaagcaucaggaagaaucacagucucuaccaaaagaagucaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacggagugggagaagcucaauaaugagaucagaugcacccauugacaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucaggaaaaccaaugagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugauuuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39382 - RNA, 1701 nt, Artificial Sequence
  hemagglutinin__InfluenzaA__AFJ78144
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucuucuugcauaagaagaucuaauaacaguuucuuuaguagauugaauugguugacccacuuaaaauucaaauauccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaguagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39383 - RNA, 1701 nt, Artificial Sequence; identical to SEQ ID NO: 39382
  hemagglutinin__InfluenzaA__AFJ78155

SEQ ID NO: 39384 - RNA, 1701 nt, Artificial Sequence
  hemagglutinin__InfluenzaA__AFJ78166
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaggcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39385 - RNA, 1701 nt, Artificial Sequence
  hemagglutinin__InfluenzaA__AFJ78177
augaagaccaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauuuucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39386 - RNA, 1701 nt, Artificial Sequence
  hemagglutinin__InfluenzaA__AFJ78188
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39387 - RNA, 1701 nt, Artificial Sequence
  hemagglutinin__InfluenzaA__AFJ78210
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcauugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39388 - RNA, 1701 nt, Artificial Sequence
  hemagglutinin__InfluenzaA__AFJ78221
augaagacuaucauugcuuugagcuacauucuauguuugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaacaacaguuucuuuaguagauugaauugguugacccacuuaaaauucaaauacccagcauugaaugugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauauuggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcaccuauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39389 - RNA, 1701 nt, Artificial Sequence
  hemagglutinin__InfluenzaA__AFJ78232
augaagacuaucauugcuuugagcuacauucuauguuugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacagguaaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaacaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauauuggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcaccuauuggcaaaugcaauucugaaugcaucacuccaaauggaagcauucccaaugacaaaccauuccaaaauguaaacaggaucacauacggcgccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucgaucaaaucaaugggaagcugaauagguugaucgggaaaaccaacgagaaauuccaucagauugaaaacgaauucucagaagucgaagggagaauucaggaccuugagaaauauguugaggacaccaaaauagaucucuggucauacaacgcggagcuucuuguugcccuggagaaccaacauacaauugaucuaaccgacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39390 - RNA, 1701 nt, Artificial Sequence
  hemagglutinin__InfluenzaA__AFJ78243
augaagacuaucauugcuuugagcuacauucuauguuugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaacaacaguuucuuuaguagauugaauugguugacccacuuaaaauucaaauacccagcauugaacgugacuaugccaaacaaugaagaauuugacaaauuguacauuugggggguucaccauccggguacggacaaugaccaaaucuuccuguaugccaaagcaucaggaagaaucacagucucuaccaaaagaagccaacaaacuguaaucccgaauauuggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccguuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcauaaaaauucugagggaacaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39391 - RNA, 1701 nt, Artificial Sequence
  hemagglutinin__InfluenzaA__AFJ78254
augaagacuaucauugcuuugagcuacauucuaugucugguuuucgcucaaaaacuuccuggaaaugacaacagcacggcaacacugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauauccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagaaaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaguagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacgauguauacagagaugaagcauuaaauaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39392 - RNA, 1701 nt, Artificial Sequence; identical to SEQ ID NO: 39391
  hemagglutinin__InfluenzaA__AFJ78265

SEQ ID NO: 39393 - RNA, 1701 nt, Artificial Sequence
  hemagglutinin__InfluenzaA__AFJ78276
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggaguuacucaaaacggaacaagcucugcuugcauaaggagaucuaauaacaguuucuuuaguagauugaauugguugacccacuuaaaauucaaauauccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaguagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaauaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39394 - RNA, 1701 nt, Artificial Sequence
  hemagglutinin__InfluenzaA__AFJ78287
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauggaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuucccguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39395 - RNA, 1698 nt, Artificial Sequence
  hemagglutinin__InfluenzaA__AFJ78309
augaaagcaaaacuacuaguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuagguaauugcagcguugccggauggaucuuaggaaacccagaaugcgaaucacugauuucuaaggaaucaugguccuacauuguagagacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucggcaucaugcucccauaaugggaaaagcaguuuuuacagaaauuugcuauggcugacggagaagaauggcuuguacccaaaccugagcaaguccuauguaaacaacaaagagaaagaaguccuuguacuaugggguguucaucacccgucuaacauaggggaccaaagggccaucuaucauacagaaaaugcuuaugucucuguagugucuucacauuauagcagaagauucaccccagaaauagcaaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugccaaacaccucagggagcuauaaacaguagucuuccuuuccagaauguacacccaaucacaauaggagaguguccaaaguaugucaggagugcaaaauuaaggaugguuacaggacuaaggaacaucccauccauucaauccagagguuuguuuggagccauugccgguuucauugaagggggguggacuggaaugauagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggauuucuggacauuuggacauauaaugcagaauuguugguucuacuggaaaaugaaaggacuuuggauuuccaugacucaaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucacugguucuuuuggucucccugggggcaaucagcuucuggauguguuccaaugggucuuugcaguguagaauaugcaucuga

SEQ ID NO: 39396 - RNA, 1701 nt, Artificial Sequence
  hemagglutinin__InfluenzaA__AFJ78320
augaagacuaucauugcuuugagcuacauuuuaugucugguuuucgcucaaaaacuucccggaaaugacaacagcacggcaacgcugugccuggggcaccaugcaguaccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuauacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgggaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39397 - RNA, 1698 nt, Artificial Sequence
  hemagglutinin__InfluenzaA__AFJ78331
augaaagcaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuauguaaacaacaaagagaaagaaguccuugugcuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaaccuggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuggacauuuggacauauaaugcagaauuguugguucuacuggaaaaugaaaggacuuuggauuuccaugauuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 39398 - RNA, 1698 nt, Artificial Sequence; identical to SEQ ID NO: 39397
  hemagglutinin__InfluenzaA__AFJ78342

SEQ ID NO: 39399 - RNA, 1698 nt, Artificial Sequence
  hemagglutinin__InfluenzaA__AFJ78353
augaaagcaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaagucuuauguaaacaacaaagagaaagaaguccuugugcuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcaccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggcuuucuggacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 39400 - RNA, 1698 nt, Artificial Sequence
  hemagglutinin__InfluenzaA__AFJ78364
augaaagcaaaacuacuaguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuagguaauugcagcguugccggauggaucuuaggaaacccagaaugcgaaucacugauuuccaaggaaucaugguccuacauuguagagacaccaaauccugagaauggaacauguuacccaggguauuucgccgacuaugaggaacugagggagcaauugaguucaguaucuucauuugagagauucgaaauauuccccaaagaaagcucauggcccaaccacacuguaaccggaguaucggcaucaugcucccauaaugggaaaagcaguuuuuacagaaauuugcuauggcugacggagaagaauggcuuguacccaaaccugagcaaguccuauguaaacaacaaagagaaagaaguccuuguacuaugggguguucaucacccgucuaacauaggggaccaaagggccaucuaucauacagaaaaugcuuaugucucuguagugucuucacauuauaacagaagauucaccccagaaauagcaaaaagacccaaaguaagaaaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcaaagugccaaacaccucagggagcuauaaacaguagucuuccuuuccagaauguacacccaaucacaauaggagaguguccaaaguaugucaggagugcaaaauuaaggaugguuacaggacuaaggaacaucccauccauucaauccagagguuuguuuggagccauugccgguuucauugaagggggguggacuggaaugauagaugggugguaugguuaucaucaucagaaugagcaaggaucuggcuaugcugcagaucaaaaaagcacacaaaaugccauuaacgggaucacaaacaaggugaauucugugauugagaaaaugaacacucaauucacagcugugggcaaagaauucaacaaauuagaaagaaggauggaaaacuuaaacaaaaaaguugaugauggauuucuggacauuuggacauauaaugcagaauugcugguucuacuggaaaaugaaaggacuuuggauuuccaugacucaaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucacugguucuuuuggucucccugggggcaaucagcuucuggauguguuccaaugggucuuugcaguguagaauaugcaucuga

SEQ ID NO: 39401 - RNA, 1698 nt, Artificial Sequence
  hemagglutinin__InfluenzaA__AFJ78375
augaaagcaaaacuacuaguccuguuauguacauuuacagcuacauaugcagacacgauauguauaggcuaccaugccaacaacucaaccgacacuguugacacaguacuugagaagaauguuacagugacacacucuaucaaccuacuugagaacagucacaauggaaaauuaugucuacuaaaaggaauagccccacuacaauuggguaauugcagcguugccggauggaucuuaggaaacccagaaugcgaauuacugauuucuaaggaaucaugguccuacauuguagaaacaccaaauccugagaauggaacauguuacccagggcauuucgccgacuaugaggaacugagggagcaauugaguucaguauccucauuugagagauucgaaauauuccccaaagaaagcucauggcccaaccacaccguaaccggaguaucggcaucaugcucccauaaugggaaaagcaguuuuuacagaaauuugcuauggcugacggagaagaauggcuuguacccaaaccugagcaaguccuauguaaacaacaaagagaaagaaguccuuguacuaugggguguucaucacccgucuaacauaggggaccaaagggccaucuaucauacagaaaaugcuuaugucucuguagugucuucacauuauagcagaagauucaccccagaaauagucaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccagucacaauaggagaguguccaaaguauguaaggagugcaaaauuaaggaugguuacaggacuaaggaacaucccauccauucaauccagagguuuguuuggagccauugccgguuucauugaagggggguggacuggaaugauagaugggugguaugguuaucaucaucagaaugagcaaggaucugguuaugcugcagaucaaaaaagcacacagaaugccauuaacgggauuacaaacaaggugaauucuauaauugagaaaaugaacacucaauucacagcugugggcaaagaauucaacaaauuagaaagaaggauggaaaacuuaaauaaaaaaguugaugauggauuucuagacauuuggacauauaaugcagaauuguugguucuacuagaaaaugaaaggacuuuggauuuccaugacucaaaugugaagaaucuguaugagaaaguaaaaagccaauuaaagaauaaugccaaagaaauaggaaacggguguuuugaauucuaucacaaauguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucacugguucuuuuggucucccugggggcaaucagcuucuggauguguuccaaugggucuuugcaguguagaauaugcaucuga

SEQ ID NO: 39402 - RNA, 1698 nt, Artificial Sequence; identical to SEQ ID NO: 32629
  hemagglutinin__InfluenzaA__AFJ78386

SEQ ID NO: 39403 - RNA, 1698 nt, Artificial Sequence; identical to SEQ ID NO: 32629
  hemagglutinin__InfluenzaA__AFJ78397

SEQ ID NO: 39404 - RNA, 1698 nt, Artificial Sequence
  hemagglutinin__InfluenzaA__AFJ78408
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugaucuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaauagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 39405 - RNA, 1698 nt, Artificial Sequence
  hemagglutinin__InfluenzaA__AFJ78419
augaaaguaaaacuacugguccuguuaugcacauuuacagcuacauaugcagacacaauauguauaggcuaccaugccaacaacucaaccgacacuguugacacaguacuugagaaaaaugugacagugacacacucugucaaccugcuugaggacagucacaauggaaaacuaugucuauuaaaaggaauagccccacuacaauuggguaauugcagcguugccggguggaucuuaggaaacccagaaugcgaauuacugauuuccaaggaaucaugguccuacauuguagaaaaaccaaauccugagaauggaacauguuacccaggguauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaguaauauuugaggcaaauggaaaucuaauagcgccaagauaugcuuucgcacugaguagaggcuuuggaucaggaaucaucaacucaaaugcaccaauggaugaaugugaugcgaagugccaaacaccccagggagcuauaaacagcagucuuccuuuccagaauguacacccagucacaauaggagaguguccaaaguaugucaggagugcaaaauuaaggaugguuacaggacuaaggaacaucccauccauucaauccagaggucuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaggaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39406 - RNA, 1698 nt, Artificial Sequence
  hemagglutinin__InfluenzaA__AFJ78430
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcaguguugccggauggaucuuaggaaacccagaaugcgaauuacugauuuccagggaaucaugguccuacauuguagaaaacccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucugcuuggacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39407 - RNA, 1698 nt, Artificial Sequence
  hemagglutinin__InfluenzaA__AFJ78441
augaaaguaaaacuaaugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagagaaucaugguccuacauuguagaaaaaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucuggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcuguggacaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39408 - RNA, 1698 nt, Artificial Sequence
  hemagglutinin__InfluenzaA__AFJ78452
augaaaguaaaacuacugguccuguuaugcacauuuacagcuacauaugcagacacaauauguauaggcuaccaugccaacaacucaaccgacacuguugacacaguacuugaaaagaaugugacagugacacacucugucaaccugcuugaggacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcacuucgcugacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccaaacauaggugaccaaaaggcccucuaucauacagaaaaugcuuaugucucuguagugucuucacauuauagcagaaaauucaucccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucauuaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuuaaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugccaaagaaauaggaaauggguguuuugaauucuaucacaaguguaacgaugaaugcauggagaguguaaaaaauggaacuuaugacuacccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39409 - RNA, 1698 nt, Artificial Sequence
  hemagglutinin__InfluenzaA__AFJ78463
augaaaguaaaacuacugguccuguuaugcacauuuacagcuacauaugcagacacaauauguauaggcuaccaugccaacaacucaaccgacacuguugacacaguacuugaaaagaaugugacagugacacacucugucaaccugcuugaggacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcacuucgcugacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaaccugggcaaguccuaugcaaacaacaaagagaaagaaguccuuguacuaugggguguucaucacccgccaaacauaggugaccaaaaggcccucuaucauacagaaaaugcuuaugucucuguagugucuucacauuauagcagaaaauucaucccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucauuaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuuaaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugccaaagaaauaggaaauggguguuuugaauucuaucacaaguguaacgaugaaugcauggagaguguaaaaaauggaacuuaugacuacccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39410 - RNA, 1698 nt, Artificial Sequence
  hemagglutinin__InfluenzaA__AFJ78474
augaaaguaaaacuacugguccuguuaugcacauuuacugcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugaaagauucgaaauauuccccaaagaaagcucauggcccaaccacaccguaaccggaguaucagcaucaugcuccuauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaagggcccucuaucauacagaaaaugcuuaugucucuguagugucuucacauuauagcagaaaauucaccccagaaauagccaaaagacccaaaguaagagaucaagaaggaagaaucaacuauuacuggacucugcuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguccuuuuggucucccugggggcaaucagcuucuggauguguuccaaugggucuuugcaguguagaauaugcaucuaa

SEQ ID NO: 39411 - RNA, 1698 nt, Artificial Sequence
  hemagglutinin__InfluenzaA__AFJ78485
augaaaguaaaacuacugguucuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugagagauucgaaauauuccccaaagaaagcucauggcccaaccacaccacaaccggaguaucagcaucaugcucccauaauggggaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugaaaaaaugaacacucaauucacagcugugggcaaagaauucaacaaauuggaaagaaggauggaaaacuuaaauaaaaaaguugaagauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39412 - RNA, 1698 nt, Artificial Sequence
  hemagglutinin__InfluenzaA__AFJ78496
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugagagauucgaaauauuccccaaagaaagcucauggcccaaccacaccacaaccggaguaucagcaucaugcucccauaauggggaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauagguggccaaagggcucucuaucauacagaaaaugcuuaugucucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccugucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39413 - RNA, 1698 nt, Artificial Sequence
  hemagglutinin__InfluenzaA__AFJ78518
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugagagauucgaaauauuccccaaagaaagcucauggcccaaccacaccacaaccggaguaucagcaucaugcucccauaauggggaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaagggcucucuaucauacagaaaaugcuuaugucucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccugucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugguucuuugcaguguagaauaugcaucuaa

SEQ ID NO: 39414 - RNA, 1698 nt, Artificial Sequence
  hemagglutinin__InfluenzaA__AFJ78529
augaaaguaaaacuacugguccuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaagaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaacggggaaagcagcuuuuacaaaaauuugcuauggcugacgggaaagaaugguuuguacccaaaccugagcaaguccuaugcaaacaacaaagagaaagaaguccucguacuaugggguguucaucacccgccaaacauaggugaccaaaugacccucuaucauaaagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaaugggaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaacucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugaaaggacuuuggauuuccaugacuccaaugugaagaauuuguaugagaaaguaaaaaaccaauuaaagaauaaugccaaagaaauaggaaauggguguuuugaauuuuaucacaaguguaacgaugaaugcauggagaguguaaaaaauggaacuuaugauuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39415 - RNA, 1698 nt, Artificial Sequence; identical to SEQ ID NO: 39414
  hemagglutinin__InfluenzaA__AFJ78540

SEQ ID NO: 39416 - RNA, 1698 nt, Artificial Sequence; identical to SEQ ID NO: 39414
  hemagglutinin__InfluenzaA__AFJ78551

SEQ ID NO: 39417 - RNA, 1698 nt, Artificial Sequence
  hemagglutinin__InfluenzaA__AFJ78562
augaaaguaaaacuacugguccuauuaugcacauucacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaagaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaacggggaaagcagcuuuuacaaaaauuugcuauggcugacgggaaagaaugguuuguacccaacccugagcaaguccuaugcaaacaacaaagagaaagaaguccucguacuaugggguguucaucacccgccaaacauaggugaccaaaugacccucuaucauaaagaaaaugcuuaugucucuguagugucuucacauuauagcagaaaauucaccccagaaauagccaaaagacucaaaguaagagaucaagaaggaagaaucaacuacuacuggacucugcuugaacccggggauacaauaauauuugaggcaaaugggaaucuaauagcgccaagauaugcuuucgcacugaguagaggccuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaacucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugaaaggacuuuggauuuccaugacuccaaugugaagaauuuguaugagaaaguaaaaaaccaauuaaagaauaaugccaaagaaauaggaaauggguguuuugaauuuuaucacaaguguaacgaugaaugcauggagaguguaaaaaauggaacuuaugauuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39418 - RNA, 1698 nt, Artificial Sequence
  hemagglutinin__InfluenzaA__AFJ78573
augaaaguaaaacuacugguccuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaagaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaacggggaaagcagcuuuuacaaaaauuugcuauggcugacgggaaagaaugguuuguacccaaaccugagcaaguccuaugcaaacaacaaagagaaagaaguccucguacuaugggguguucaucacccgccaaacauaggugaccaaaugacccucuaucauaaagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaaugggaaucuaauagcgccaagauaugcuuucgcacugaguagaggcuuuggaucaggaaucaucaacucaaaugcaucaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaacucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugaaaggacuuuggauuuccaugacuccaaugugaagaauuuguaugagaaaguaaaaaaccaauuaaagaauaaugccaaagaaauaggaaauggguguuuugaauuuuaucacaaguguaacgaugaaugcauggagaguguaaaaaauggaacuuaugauuauccaaaauauuccgaagaagcaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39419 - RNA, 1698 nt, Artificial Sequence
  hemagglutinin__InfluenzaA__AFJ78584
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacgaggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucgcaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39420 - RNA, 1698 nt, Artificial Sequence
  hemagglutinin__InfluenzaA__AFJ78595
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacagagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39421 - RNA, 1698 nt, Artificial Sequence
  hemagglutinin__InfluenzaA__AFJ78617
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccaugauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaagugaccaaaagacccucuaucauacagaaaaugcucauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagguaugcuuucgcacugaguagaggcuuuggaucaggaaucaucaacucgaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugagcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugaaaaaguaaaaagccaguuaaagaauaaugcuaaagaaauaggaaauggguguuuugaauucuaucacaaguguaaugaugaaugcauggagaguguaaagaauggaacuuaugacuauccaaaauauuccgaagaaucgaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39422 - RNA, 1698 nt, Artificial Sequence
  hemagglutinin__InfluenzaA__AFJ78628
augaaaguaaaacuacugguccuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaagaccaaauccugagaauggaacauguuacccaggacauuucgccgacuaugaggaacugagggagcaauugaguucaguaucuucauuugagagguucgaaauauuccccaaagaaagcucauggcccaaccacaccguaaccggaguaucagcaucaugcucccauaacggggaaagcagcuuuuacaaaaauuugcuauggcugacgggaaagaaugguuuguacccaaaccugagcaaguccuaugcaaacaacaaagagaaagaaguccucguacuaugggguguucaucacccgccaaacauagguaaccaaaugacccucuaucauaaagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaaugggaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaacucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugaaaggacuuuggauuuccaugacuccaaugugaagaauuuguaugagaaaguaaaaaaccaauuaaagaauaaugccaaagaaauaggaaauggguguuuugaauuuuaucacaaguguaacgaugaaugcauggagaguguaaaaaauggaacuuaugauuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39423 - RNA, 1698 nt, Artificial Sequence
  hemagglutinin__InfluenzaA__AFJ78639
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaaguaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagguaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacagggcuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucgaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39424 - RNA, 1698 nt, Artificial Sequence
  hemagglutinin__InfluenzaA__AFJ78650
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaaguaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagguaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauccaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaaugaugaaugcauggagaguguaaagaauggaacuuaugacuauccaaaauauuccgaagaaucgaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39425 - RNA, 1701 nt, Artificial Sequence; identical to SEQ ID NO: 33801
  hemagglutinin__InfluenzaA__AFJ78661

SEQ ID NO: 39426 - RNA, 1701 nt, Artificial Sequence
  hemagglutinin__InfluenzaA__AFJ78681
augaaggcaauacuaguaguucugcuauauacauuugcaaccguaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaauuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39427 - RNA, 1701 nt, Artificial Sequence; identical to SEQ ID NO: 33173
  hemagglutinin__InfluenzaA__AFJ78691

SEQ ID NO: 39428 - RNA, 1701 nt, Artificial Sequence
  hemagglutinin__InfluenzaA__AFJ78701
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucaaaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39429 - RNA, 1701 nt, Artificial Sequence
  hemagglutinin__InfluenzaA__AFJ78711
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggauauuuggacuuacaaugccgaacuguugguucuauuggaaaaugaaagaacuuuggacuaccacgauucaaaugugaagaacuuauaugaaaggguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39430 - RNA, 1701 nt, Artificial Sequence; identical to SEQ ID NO: 33173
  hemagglutinin__InfluenzaA__AFJ78721

SEQ ID NO: 39431 - RNA, 1701 nt, Artificial Sequence
  hemagglutinin__InfluenzaA__AFJ78731
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaggguucuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39432 - RNA, 1701 nt, Artificial Sequence; identical to SEQ ID NO: 34337
  hemagglutinin__InfluenzaA__AFJ78741

SEQ ID NO: 39433 - RNA, 1701 nt, Artificial Sequence; identical to SEQ ID NO: 33173
  hemagglutinin__InfluenzaA__AFJ78751

SEQ ID NO: 39434 - RNA, 1701 nt, Artificial Sequence; identical to SEQ ID NO: 33173
  hemagglutinin__InfluenzaA__AFJ78761

SEQ ID NO: 39435 - RNA, 1701 nt, Artificial Sequence; identical to SEQ ID NO: 33173
  hemagglutinin__InfluenzaA__AFJ78771

SEQ ID NO: 39436 - RNA, 1701 nt, Artificial Sequence; identical to SEQ ID NO: 33173
  hemagglutinin__InfluenzaA__AFJ78781

SEQ ID NO: 39437 - RNA, 1701 nt, Artificial Sequence; identical to SEQ ID NO: 33801
  hemagglutinin__InfluenzaA__AFJ78791

SEQ ID NO: 39438 - RNA, 1701 nt, Artificial Sequence
  hemagglutinin__InfluenzaA__AFJ78801
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagucucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39439 - RNA, 1701 nt, Artificial Sequence; identical to SEQ ID NO: 34034
  hemagglutinin__InfluenzaA__AFJ78811

SEQ ID NO: 39440 - RNA, 1701 nt, Artificial Sequence; identical to SEQ ID NO: 33801
  hemagglutinin__InfluenzaA__AFJ78821

SEQ ID NO: 39441 - RNA, 1701 nt, Artificial Sequence; identical to SEQ ID NO: 33801
  hemagglutinin__InfluenzaA__AFJ78831

SEQ ID NO: 39442 - RNA, 1701 nt, Artificial Sequence; identical to SEQ ID NO: 34371
  hemagglutinin__InfluenzaA__AFJ78841

SEQ ID NO: 39443 - RNA, 1701 nt, Artificial Sequence
  hemagglutinin__InfluenzaA__AFJ78851
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggagauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39444 - RNA, 1701 nt, Artificial Sequence
  hemagglutinin__InfluenzaA__AFJ78861
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcagacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaagauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39445 - RNA, 1701 nt, Artificial Sequence
  hemagglutinin__InfluenzaA__AFJ78881
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacaucaaguucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 39446 - RNA, 1701 nt, Artificial Sequence; identical to SEQ ID NO: 33173
  hemagglutinin__InfluenzaA__AFJ78891

SEQ ID NO: 39447 - RNA, 1701 nt, Artificial Sequence; identical to SEQ ID NO: 34631
  hemagglutinin__InfluenzaA__AFJ78901

SEQ ID NO: 39448 - RNA, 1701 nt, Artificial Sequence; identical to SEQ ID NO: 33173
  hemagglutinin__InfluenzaA__AFJ78911

SEQ ID NO: 39449 - RNA, 1701 nt, Artificial Sequence
  hemagglutinin__InfluenzaA__AFJ78921
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauacguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuacucaacugucgccaguucauugguacugguagucucccugggggcaaucaguuucuggaugugcucuaaugggucucuacaguguagaauauguauuuaa

SEQ ID NO: 39450 - RNA, 1701 nt, Artificial Sequence
  hemagglutinin__InfluenzaA__AFJ97567
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguuuaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccaagggugcuauaaacaccagcuucccauuucagaauauacauccgaucacaauuggaaaguguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39451 - RNA, 1701 nt, Artificial Sequence
  hemagglutinin__InfluenzaA__AFK14115
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuauauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagaccuaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39452 - RNA, 1701 nt, Artificial Sequence; identical to SEQ ID NO: 33472
  hemagglutinin__InfluenzaA__AFK14131

SEQ ID NO: 39453 - RNA, 1701 nt, Artificial Sequence
  hemagglutinin__InfluenzaA__AFK14139
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuuuuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagaauggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39454 - RNA, 1701 nt, Artificial Sequence
  hemagglutinin__InfluenzaA__AFK14148
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39455 - RNA, 1701 nt, Artificial Sequence; identical to SEQ ID NO: 38101
  hemagglutinin__InfluenzaA__AFK14157

SEQ ID NO: 39456 - RNA, 1701 nt, Artificial Sequence
  hemagglutinin__InfluenzaA__AFK14166
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuccuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39457 - RNA, 1701 nt, Artificial Sequence; identical to SEQ ID NO: 34501
  hemagglutinin__InfluenzaA__AFK14175

SEQ ID NO: 39458 - RNA, 1701 nt, Artificial Sequence; identical to SEQ ID NO: 38100
  hemagglutinin__InfluenzaA__AFK14184

SEQ ID NO: 39459 - RNA, 1701 nt, Artificial Sequence
  hemagglutinin__InfluenzaA__AFK14193
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcgggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39460 - RNA, 1701 nt, Artificial Sequence; identical to SEQ ID NO: 37900
  hemagglutinin__InfluenzaA__AFK14202

SEQ ID NO: 39461 - RNA, 1701 nt, Artificial Sequence
  hemagglutinin__InfluenzaA__AFK14211
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcgggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39462 - RNA, 1701 nt, Artificial Sequence
  hemagglutinin__InfluenzaA__AFK14220
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagcgucaucauuugaaagguaugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39463 - RNA, 1701 nt, Artificial Sequence; identical to SEQ ID NO: 38101
  hemagglutinin__InfluenzaA__AFK14229

SEQ ID NO: 39464 - RNA, 1701 nt, Artificial Sequence
  hemagglutinin__InfluenzaA__AFK14238
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacacccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaagugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39465 - RNA, 1701 nt, Artificial Sequence
  hemagglutinin__InfluenzaA__AFK14247
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuuuuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuaugaacaccagccucccauuucagaauauacauccgaucacaauuggaaaauguccaaaauauguaaaaagcacaaaauugagaauggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39466 - RNA, 1701 nt, Artificial Sequence
  hemagglutinin__InfluenzaA__AFK14272
augaaggcaauacuaauaguucugcuauauacauuugcaacugcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaacagggguagccccauugcauuuggguaaaugugacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39467 - RNA, 1701 nt, Artificial Sequence; identical to SEQ ID NO: 39459
  hemagglutinin__InfluenzaA__AFK14314

SEQ ID NO: 39468 - RNA, 1701 nt, Artificial Sequence
  hemagglutinin__InfluenzaA__AFK14323
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagucaguuaaaaaacaaugccaaggaaauuggaaacggcugcuuugaauuuuaccacaagugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39469 - RNA, 1701 nt, Artificial Sequence
  hemagglutinin__InfluenzaA__AFK14332
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaagugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39470 - RNA, 1701 nt, Artificial Sequence
  hemagglutinin__InfluenzaA__AFK14341
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccacuuggaaaaaagaauagagaauuuaaauaaaaaaguugaugaugguuuccuggacauuuggacuuacaaugccgaacuguugguucuauuggaaaaugaaaaaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39471 - RNA, 1701 nt, Artificial Sequence
  hemagglutinin__InfluenzaA__AFK14350
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcugaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39472 - RNA, 1701 nt, Artificial Sequence
  hemagglutinin__InfluenzaA__AFK14358
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggagcguguuacccaggagauuucaucgauuaugaggagcuaagagagcaauugagcucagugucaucauuugaaagguuugagaucuuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccacuuggaaaaaagaauagagaauuuaaauaaaaaaguugaugaugguuuccuggacauuuggacuuacaaugccgaacuguugguucuauuggaaaaugaaaaaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39473 - RNA, 1701 nt, Artificial Sequence
  hemagglutinin__InfluenzaA__AFK14395
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagaaaauggaauguguugcccaagagauuucaucgauuaugaggagcuaagagagcaauugagcucagucucaucauuugaaagguuugagauauuccccaagacaagcucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 39474 - RNA, 1701 nt, Artificial Sequence
  hemagglutinin__InfluenzaA__AFK14431
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuuccucgauuaugaagagcuuagaaagcaauugagcucagugucaucauuugaaaggguugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39475 - RNA, 1701 nt, Artificial Sequence; identical to SEQ ID NO: 33173
  hemagglutinin__InfluenzaA__AFK14456

SEQ ID NO: 39476 - RNA, 1701 nt, Artificial Sequence
  hemagglutinin__InfluenzaA__AFK14465
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39477 - RNA, 1701 nt, Artificial Sequence
  hemagglutinin__InfluenzaA__AFK14536
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacauauaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacacuagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauaugcauuuaa

SEQ ID NO: 39478 - RNA, 1701 nt, Artificial Sequence; identical to SEQ ID NO: 39451
  hemagglutinin__InfluenzaA__AFK14571

SEQ ID NO: 39479 - RNA, 1701 nt, Artificial Sequence; identical to SEQ ID NO: 37682
  hemagglutinin__InfluenzaA__AFK14586

SEQ ID NO: 39480 - RNA, 1701 nt, Artificial Sequence
  hemagglutinin__InfluenzaA__AFK14595
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaaaagggguagccccauugcauuuggguaaauguaacauugcuggcuggauccugggaaauccaaagugugaaucacucuccacagcaagcucaugguccuacauuggggaaacaucuaguucaaacaauggaacguguuacccaggaaauuucaucgauuuugaggagcuaaaaaagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuauauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagaccuaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39481 - RNA, 1701 nt, Artificial Sequence
  hemagglutinin__InfluenzaA__AFK14612
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuaggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaaaccggaaauagcaauaagacccaaaguaagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuguaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39482 - RNA, 1701 nt, Artificial Sequence
  hemagglutinin__InfluenzaA__AFK14621
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaaggaaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39483 - RNA, 1701 nt, Artificial Sequence
  hemagglutinin__InfluenzaA__AFK14630
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagggcugaccuacaaaguaucaaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39484 - RNA, 1701 nt, Artificial Sequence
  hemagglutinin__InfluenzaA__AFK14639
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguagggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaggccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39485 - RNA, 1701 nt, Artificial Sequence; identical to SEQ ID NO: 39451
  hemagglutinin__InfluenzaA__AFK14661

SEQ ID NO: 39486 - RNA, 1701 nt, Artificial Sequence; identical to SEQ ID NO: 37682
  hemagglutinin__InfluenzaA__AFK14670

SEQ ID NO: 39487 - RNA, 1701 nt, Artificial Sequence; identical to SEQ ID NO: 37682
  hemagglutinin__InfluenzaA__AFK14678

SEQ ID NO: 39488 - RNA, 1701 nt, Artificial Sequence
  hemagglutinin__InfluenzaA__AFK14688
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuaggaaauccagagugugaaucacucuccacagcaagcucaugguccuacauuguggaaacaucuaguucagacaauggaacguguuacccaggagauuucauccaugaugaagagcuaagaaagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaagcuggaucugguauuaucauuuuagauacaccaguccacgauuggaauacaacuugugagacacccaagggugcuguaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39489 - RNA, 1701 nt, Artificial Sequence; identical to SEQ ID NO: 37682
  hemagglutinin__InfluenzaA__AFK14697

SEQ ID NO: 39490 - RNA, 1701 nt, Artificial Sequence
  hemagglutinin__InfluenzaA__AFK14713
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuaggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuguaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaacgccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39491 - RNA, 1701 nt, Artificial Sequence; identical to SEQ ID NO: 37682
  hemagglutinin__InfluenzaA__AFK14722

SEQ ID NO: 39492 - RNA, 1701 nt, Artificial Sequence
  hemagglutinin__InfluenzaA__AFK14731
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuaggaaauccagagugugaaucacucuccacagcaagcucaugguccuacauuguggaaacaucuaguucagacaauggaacguguuacccaggagauuucaucgauuaugaagagcuaagaaagcaauugagcucagugucaucauuugaaaggguugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuguaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39493 - RNA, 1701 nt, Artificial Sequence; identical to SEQ ID NO: 37682
  hemagglutinin__InfluenzaA__AFK14740

SEQ ID NO: 39494 - RNA, 1701 nt, Artificial Sequence; identical to SEQ ID NO: 37682
  hemagglutinin__InfluenzaA__AFK14749

SEQ ID NO: 39495 - RNA, 1701 nt, Artificial Sequence
  hemagglutinin__InfluenzaA__AFK14756
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuaggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuguaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugagaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39496 - RNA, 1701 nt, Artificial Sequence; identical to SEQ ID NO: 37682
  hemagglutinin__InfluenzaA__AFK14764

SEQ ID NO: 39497 - RNA, 1701 nt, Artificial Sequence
  hemagglutinin__InfluenzaA__AFK14779
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaggagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuugugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39498 - RNA, 1701 nt, Artificial Sequence
  hemagglutinin__InfluenzaA__AFK14788
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaagcuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcuccgcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacaaaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 39499 - RNA, 1701 nt, Artificial Sequence
  hemagglutinin__InfluenzaA__AFK14798
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuuagaaagcaauugagcucagugucaucauuugaaaggguugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaauggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaacaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaauguagaauauguauuuaa

SEQ ID NO: 39500 - RNA, 1701 nt, Artificial Sequence
  hemagglutinin__InfluenzaA__AFK14814
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauaugaaagguaugagauauuccccaagacaaguucauggcccaaucaugacucgaacaaagguguaacggcagcauguccucaugcgggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39501 - RNA, 1701 nt, Artificial Sequence
  hemagglutinin__InfluenzaA__AFK14831
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucagcgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaaggaaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39502 - RNA, 1701 nt, Artificial Sequence; identical to SEQ ID NO: 39482
  hemagglutinin__InfluenzaA__AFK14839

SEQ ID NO: 39503 - RNA, 1701 nt, Artificial Sequence
  hemagglutinin__InfluenzaA__AFK14847
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagcgucaucauuugaaagguaugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39504 - RNA, 1701 nt, Artificial Sequence; identical to SEQ ID NO: 37682
  hemagglutinin__InfluenzaA__AFK14868

SEQ ID NO: 39505 - RNA, 1701 nt, Artificial Sequence; identical to SEQ ID NO: 34337
  hemagglutinin__InfluenzaA__AFK14884

SEQ ID NO: 39506 - RNA, 1701 nt, Artificial Sequence; identical to SEQ ID NO: 34337
  hemagglutinin__InfluenzaA__AFK14892

SEQ ID NO: 39507 - RNA, 1701 nt, Artificial Sequence; identical to SEQ ID NO: 34337
  hemagglutinin__InfluenzaA__AFK14901

SEQ ID NO: 39508 - RNA, 1701 nt, Artificial Sequence; identical to SEQ ID NO: 34337
  hemagglutinin__InfluenzaA__AFK14910

SEQ ID NO: 39509 - RNA, 1701 nt, Artificial Sequence
  hemagglutinin__InfluenzaA__AFK14919
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugaugagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39510 - RNA, 1701 nt, Artificial Sequence; identical to SEQ ID NO: 39509
  hemagglutinin__InfluenzaA__AFK14929

SEQ ID NO: 39511 - RNA, 1701 nt, Artificial Sequence
  hemagglutinin__InfluenzaA__AFK25599
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 39512 - RNA, 1701 nt, Artificial Sequence
  hemagglutinin__InfluenzaA__AFK25601
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagaguguguaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguggauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 39513 - RNA, 1701 nt, Artificial Sequence
  hemagglutinin__InfluenzaA__AFK25603
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacucagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 39514 - RNA, 1701 nt, Artificial Sequence
  hemagglutinin__InfluenzaA__AFK25605
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaagaagcacaaaauugagacuggccacaggauugaggaaugucccgucuauucaaucuagaggccuauuuggggccauugccggcuucauugaagggggguggacagggaugguggauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgauuuauucaacugccgccaguucauugguacugguagucucccugggggcaaucaguuuuuggaugugcucuaaugggucucuacaguguagaauauguauuuaa

SEQ ID NO: 39515 - RNA, 1701 nt, Artificial Sequence; identical to SEQ ID NO: 38918
  hemagglutinin__InfluenzaA__AFK74526

SEQ ID NO: 39516 - RNA, 1701 nt, Artificial Sequence; identical to SEQ ID NO: 33173
  hemagglutinin__InfluenzaA__AFK74534

SEQ ID NO: 39517 - RNA, 1701 nt, Artificial Sequence; identical to SEQ ID NO: 38929
  hemagglutinin__InfluenzaA__AFK74544

SEQ ID NO: 39518 - RNA, 1701 nt, Artificial Sequence; identical to SEQ ID NO: 34753
  hemagglutinin__InfluenzaA__AFK74554

SEQ ID NO: 39519 - RNA, 1701 nt, Artificial Sequence; identical to SEQ ID NO: 35277
  hemagglutinin__InfluenzaA__AFK74564

SEQ ID NO: 39520 - RNA, 1701 nt, Artificial Sequence; identical to SEQ ID NO: 37610
  hemagglutinin__InfluenzaA__AFK74575

SEQ ID NO: 39521 - RNA, 1701 nt, Artificial Sequence; identical to SEQ ID NO: 38917
  hemagglutinin__InfluenzaA__AFK74585

SEQ ID NO: 39522 - RNA, 1701 nt, Artificial Sequence
  hemagglutinin__InfluenzaA__AFK74595
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacuugaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39523 - RNA, 1701 nt, Artificial Sequence; identical to SEQ ID NO: 33803
  hemagglutinin__InfluenzaA__AFK74605

SEQ ID NO: 39524 - RNA, 1701 nt, Artificial Sequence; identical to SEQ ID NO: 38920
  hemagglutinin__InfluenzaA__AFK74615

SEQ ID NO: 39525 - RNA, 1701 nt, Artificial Sequence; identical to SEQ ID NO: 38920
  hemagglutinin__InfluenzaA__AFK74625

SEQ ID NO: 39526 - RNA, 1701 nt, Artificial Sequence; identical to SEQ ID NO: 34679
  hemagglutinin__InfluenzaA__AFK74635

SEQ ID NO: 39527 - RNA, 1701 nt, Artificial Sequence; identical to SEQ ID NO: 34679
  hemagglutinin__InfluenzaA__AFK74645

SEQ ID NO: 39528 - RNA, 1701 nt, Artificial Sequence; identical to SEQ ID NO: 38925
  hemagglutinin__InfluenzaA__AFK74655

SEQ ID NO: 39529 - RNA, 1701 nt, Artificial Sequence; identical to SEQ ID NO: 38925
  hemagglutinin__InfluenzaA__AFK74665

SEQ ID NO: 39530 - RNA, 1701 nt, Artificial Sequence; identical to SEQ ID NO: 33173
  hemagglutinin__InfluenzaA__AFK74675

SEQ ID NO: 39531 - RNA, 1701 nt, Artificial Sequence; identical to SEQ ID NO: 38929
  hemagglutinin__InfluenzaA__AFK74685

SEQ ID NO: 39532 - RNA, 1701 nt, Artificial Sequence; identical to SEQ ID NO: 37610
  hemagglutinin__InfluenzaA__AFK74695

SEQ ID NO: 39533 - RNA, 1701 nt, Artificial Sequence; identical to SEQ ID NO: 38932
  hemagglutinin__InfluenzaA__AFK74705

SEQ ID NO: 39534 - RNA, 1701 nt, Artificial Sequence; identical to SEQ ID NO: 38933
  hemagglutinin__InfluenzaA__AFK74715

SEQ ID NO: 39535 - RNA, 1701 nt, Artificial Sequence; identical to SEQ ID NO: 33990
  hemagglutinin__InfluenzaA__AFK74725

SEQ ID NO: 39536 - RNA, 1701 nt, Artificial Sequence; identical to SEQ ID NO: 33990
  hemagglutinin__InfluenzaA__AFK74735

SEQ ID NO: 39537 - RNA, 1701 nt, Artificial Sequence; identical to SEQ ID NO: 38936
  hemagglutinin__InfluenzaA__AFK74745

SEQ ID NO: 39538 - RNA, 1701 nt, Artificial Sequence; identical to SEQ ID NO: 33990
  hemagglutinin__InfluenzaA__AFK74755

SEQ ID NO: 39539 - RNA, 1701 nt, Artificial Sequence; identical to SEQ ID NO: 38939
  hemagglutinin__InfluenzaA__AFK74765

SEQ ID NO: 39540 - RNA, 1701 nt, Artificial Sequence; identical to SEQ ID NO: 38929
  hemagglutinin__InfluenzaA__AFK74775

SEQ ID NO: 39541 - RNA, 1701 nt, Artificial Sequence; identical to SEQ ID NO: 34753
  hemagglutinin__InfluenzaA__AFK74785

SEQ ID NO: 39542 - RNA, 1701 nt, Artificial Sequence; identical to SEQ ID NO: 34753
  hemagglutinin__InfluenzaA__AFK74795

SEQ ID NO: 39543 - RNA, 1701 nt, Artificial Sequence; identical to SEQ ID NO: 34753
  hemagglutinin__InfluenzaA__AFK74805

SEQ ID NO: 39544 - RNA, 1701 nt, Artificial Sequence; identical to SEQ ID NO: 34753
  hemagglutinin__InfluenzaA__AFK74815

SEQ ID NO: 39545 - RNA, 1701 nt, Artificial Sequence; identical to SEQ ID NO: 38949
  hemagglutinin__InfluenzaA__AFK74825

SEQ ID NO: 39546 - RNA, 1701 nt, Artificial Sequence; identical to SEQ ID NO: 38957
  hemagglutinin__InfluenzaA__AFK74835

SEQ ID NO: 39547 - RNA, 1701 nt, Artificial Sequence; identical to SEQ ID NO: 38949
  hemagglutinin__InfluenzaA__AFK74845

SEQ ID NO: 39548 - RNA, 1701 nt, Artificial Sequence; identical to SEQ ID NO: 38949
  hemagglutinin__InfluenzaA__AFK74895

SEQ ID NO: 39549 - RNA, 1701 nt, Artificial Sequence; identical to SEQ ID NO: 38949
  hemagglutinin__InfluenzaA__AFK74905

SEQ ID NO: 39550 - RNA, 1701 nt, Artificial Sequence; identical to SEQ ID NO: 38949
  hemagglutinin__InfluenzaA__AFK74915

SEQ ID NO: 39551 - RNA, 1701 nt, Artificial Sequence
  hemagglutinin__InfluenzaA__AFK74925
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagucccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39552 - RNA, 1701 nt, Artificial Sequence; identical to SEQ ID NO: 34572
  hemagglutinin__InfluenzaA__AFK74935

SEQ ID NO: 39553 - RNA, 1701 nt, Artificial Sequence; identical to SEQ ID NO: 38956
  hemagglutinin__InfluenzaA__AFK74945

SEQ ID NO: 39554 - RNA, 1701 nt, Artificial Sequence; identical to SEQ ID NO: 38957
  hemagglutinin__InfluenzaA__AFK74955

SEQ ID NO: 39555 - RNA, 1701 nt, Artificial Sequence; identical to SEQ ID NO: 34753
  hemagglutinin__InfluenzaA__AFK74965

SEQ ID NO: 39556 - RNA, 1701 nt, Artificial Sequence; identical to SEQ ID NO: 38959
  hemagglutinin__InfluenzaA__AFK74975

SEQ ID NO: 39557 - RNA, 1701 nt, Artificial Sequence; identical to SEQ ID NO: 38960
  hemagglutinin__InfluenzaA__AFK74985

SEQ ID NO: 39558 - RNA, 1701 nt, Artificial Sequence; identical to SEQ ID NO: 37610
  hemagglutinin__InfluenzaA__AFK74995

SEQ ID NO: 39559 - RNA, 1701 nt, Artificial Sequence; identical to SEQ ID NO: 34753
  hemagglutinin__InfluenzaA__AFK75005

SEQ ID NO: 39560 - RNA, 1701 nt, Artificial Sequence
  hemagglutinin__InfluenzaA__AFK75015
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggcuacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagaucacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguguuuaa

SEQ ID NO: 39561 - RNA, 1701 nt, Artificial Sequence; identical to SEQ ID NO: 35277
  hemagglutinin__InfluenzaA__AFK75025

SEQ ID NO: 39562 - RNA, 1701 nt, Artificial Sequence; identical to SEQ ID NO: 35277
  hemagglutinin__InfluenzaA__AFK75035

SEQ ID NO: 39563 - RNA, 1701 nt, Artificial Sequence; identical to SEQ ID NO: 35277
  hemagglutinin__InfluenzaA__AFK75045

SEQ ID NO: 39564 - RNA, 1701 nt, Artificial Sequence; identical to SEQ ID NO: 35277
  hemagglutinin__InfluenzaA__AFK75055

SEQ ID NO: 39565 - RNA, 1701 nt, Artificial Sequence; identical to SEQ ID NO: 34753
  hemagglutinin__InfluenzaA__AFK75065

SEQ ID NO: 39566 - RNA, 1701 nt, Artificial Sequence; identical to SEQ ID NO: 38970
  hemagglutinin__InfluenzaA__AFK75075

SEQ ID NO: 39567 - RNA, 1701 nt, Artificial Sequence; identical to SEQ ID NO: 38971
  hemagglutinin__InfluenzaA__AFK75085

SEQ ID NO: 39568 - RNA, 1701 nt, Artificial Sequence; identical to SEQ ID NO: 38971
  hemagglutinin__InfluenzaA__AFK75095

SEQ ID NO: 39569 - RNA, 1701 nt, Artificial Sequence; identical to SEQ ID NO: 33803
  hemagglutinin__InfluenzaA__AFK75105

SEQ ID NO: 39570 - RNA, 1701 nt, Artificial Sequence
  hemagglutinin__InfluenzaA__AFK77857
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagucaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39571 - RNA, 1701 nt, Artificial Sequence; identical to SEQ ID NO: 33457
  hemagglutinin__InfluenzaA__AFK77867

SEQ ID NO: 39572 - RNA, 1701 nt, Artificial Sequence
  hemagglutinin__InfluenzaA__AFK77877
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgagaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39573 - RNA, 1701 nt, Artificial Sequence; identical to SEQ ID NO: 33173
  hemagglutinin__InfluenzaA__AFK77887

SEQ ID NO: 39574 - RNA, 1701 nt, Artificial Sequence
  hemagglutinin__InfluenzaA__AFK77897
augaaggcaauacuaguaguucugcuauauacauuugcaaccgcaaaugcagacacauuauguauagguuaucaugcgaacaauucaacagacacuguagacacaguacuagaaaagaauguaacaguaacacacucuauuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauucccaaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuauauuaacgauaaagggaaagaaguccuagugcuauggggcauucaccauccaucuacuagugcugaccaacaaagucucuaucagaaugcagaugcauauguuuuuguggggacaucaaaauacagcaagaaguucaagccggaaauagcaguaagaccuaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacgggauugaggaaugucccgucuauucaaucuagaggucuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaauuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39575 - RNA, 1701 nt, Artificial Sequence; identical to SEQ ID NO: 38247
  hemagglutinin__InfluenzaA__AFK78028

SEQ ID NO: 39576 - RNA, 1701 nt, Artificial Sequence; identical to SEQ ID NO: 33457
  hemagglutinin__InfluenzaA__AFK78187

SEQ ID NO: 39577 - RNA, 1701 nt, Artificial Sequence
  hemagglutinin__InfluenzaA__AFM45476
augaagacuaucauugcuuugagcuacauucuaugucugguuuucgcucaaaaacucccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccauuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugaggucagaugcacccauuggcaaauguaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacggacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39578 - RNA, 1701 nt, Artificial Sequence
  hemagglutinin__InfluenzaA__AFM45487
augaagacuaucauugcuuugagcuacauucuaugucugguuuucgcucaaaaacucccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaacaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccguuuccagaucaagggaguugagcugaagucaggguacaaagauuggauccuauggauuuccuuugccauaucauguuuuuugcuuuguguugcuuuguugggguucaucaugugggcaugccaaaagggcaacauuaggugcaacauuugcauuuga

SEQ ID NO: 39579 - RNA, 1701 nt, Artificial Sequence
  hemagglutinin__InfluenzaA__AFM45489
augaagacuaucauugcuuugagcuacauucuaugucugguuuucgcucaaaaacuuccuggaaaugacaacagcacggcaacgcugugccuugggcaccaugcagugccaaacgggacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuaccccuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugauucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39580 - RNA, 1701 nt, Artificial Sequence
  hemagglutinin__InfluenzaA__AFM45494
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccucuuuguugaacgaagcaaagccuacagcaacuguuacccuuaugaugugccggauuaugccucccuuaggucacuaguugccucauccggcacacuagaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39581 - RNA, 1701 nt, Artificial Sequence
  hemagglutinin__InfluenzaA__AFM68954
augaaggcaagacuacugguccuguuaugugcacuugcagcuacagaugcagacacaauauguauaggcuaccaugcgaacaacucaaccgacacuguugacacacuacucgagaagaaugugacagugacacauucuguuaaccugcucgaagacagccacaacgggaaacuauguaaauuaaaaggaauagccccacuacaauuggggaaauguaacaucgccggauggcucuugggaaacccagaaugcgacucacugcuuccagcgagaucaugguccuacauuguagaaacaccaaacucugagaauggagcauguuauccaggagauuucaucgacuaugaggaacugaaggagcaauugagcucaguaucaucauuagaaagauucgaaauauuucccaaggaaaguucauggcccaaccacaacacacucaaaggaguaacagcaucaugcucccaugggggaaaaagcaguuuuuacagaaauuugcuauggcugacgaaaacggaggacucauacccaaagcugagcaauuccuaugugaacaauaaagggaaagaaguccuuguacuaugggguguucaucacccgucuagcagugaugagcaacagagucucuaucauaauguaaaugcuuaugucucuguagugucuucaaauuauaacgggagauucaccccggaaauagcugcaagacccaaaguaagaaaucaaccugggaggaugaacuauuacuggaccuugcuagaacccggagacacaauaauauuugaggcaacugguaaucuaauagcaccaugguaugcuuucgcacugaguagaggguuuggguccggcaucaucaccucaaacgcgucaaugcaugaguguaacacgaagugucaaacaccccagggagcuauaaacagcagucucccuuuccagaauauacacccagucacaauaggagagugcccaaaauaugucaggaguaccaaauugaggaugguuacaggacuaagaaacaucccauccauucaauucagaggucuauuuggagccauugcugguuuuauugaggggggauggacuggaaugauagauggaugguaugguuaucaucaucagaaugaacagggaucaggcuaugcagcggaucaaaaaagcacacaaaaugccauuaacgggauuacaaacaaggugaacucuguuaucgagaaaaugaacacucaauucacagcugugaguaaagaauucaacaacuuagaaaaaaggauggaaaauuuaaauaaaaaaguugaugauggauuucuggacauuuggacauauaaugcagaauuguuaguucuacuggaaaaugaaaggacuuuggauuuccaugauuuaaaugugaagaaucuguacgagaaaguaaaaagccaauuaaagaauaaugccaaagaaaucggaaauggguguuuugaguucuaccacaagugugacaauaaaugcauggaaaguguaagaaaugggacuuaugauuauccaaaauauucagaagaaucaaaguugaacagggaaaagauagauggagugaaauuggaaucaauggggguguaucagauucuggcgaucuacucaacugucgccaguucacuggugcuuuuggucucccugggggcaaucaguuucuggauguguucuaaugggucuuugcagugcagaauaugcaucuga

SEQ ID NO: 39582 - RNA, 1701 nt, Artificial Sequence
  hemagglutinin__InfluenzaA__AFM68965
augaagacuaucauugcuuugagcuacauuuucugucagguucucgcccaaaaccuuccaggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaucgaauccuugaugggaaaaacugcacacugauagaugcucuauugggggacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuaucaaugaaggcuucaauuggacuggggucacucagaaugggggaagcuaugcuugcaaaaggggaccugauaacaguuucuucaguagacugaacugguuguacaaaucagaaagcacauauccagugcugaacgugacuaugccaaacaaugacaauuuugacaaacuguacauuuggggaguucaccacccgagcacggacaaagaacaaaccaaccuauauguucaagcaucagggagagucacagucuccaccaagagaagccagcaaacuauaaucccgaaugucgggucuagacccuggguaaggggucugucuaguggaauaagcaucuauuggacaauaguaaaaccgggagacauacuguuaauuaauaguaaugggaaccuaauugcuccucgggguuacuucaaaauacgcacugggaaaagcucaauaaugaggucagaugcacccauuggcaccugcaguucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaaaagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaaaacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39583 - RNA, 1701 nt, Artificial Sequence
  hemagglutinin__InfluenzaA__AFM68987
augaagacuaucauugcuuugagcuacauuuucugucugguuuucgcccaaaaccuucccggaaaugacaacagcacagcaacgcugugccugggacaccaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuaucaaugaaggcuucaauuggacuggagucacucagagugggggaagcuaugcuugcaaaaggggaucugauaaaaguuucuucaguagacugaauugguuguacgaaucagaaagcaaauauccagugcugaacgugacuaugccaaacaauggcaauuuugacaaacuguacauuugggggguucaccacccgagcacggacaaagaacaaaccaaccuauauguucgagcaucagggagagucacagucucuaccaagagaagccagcaaacuguaaucccgaauaucgggucuagacccuggguaaggggucugucuaguagaauaaguaucuauuggacaauaguaaaaccgggagacauacuguuaauuaauaguaaugggaaccuaauugcuccucgggguuacuucaaaauacgcacugggaaaagcucaauaaugaggucagaugcaccuauuggcaccugcaguucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauacguugaagacacuaaaauagaucucuggucuuacaacgcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39584 - RNA, 1701 nt, Artificial Sequence
  hemagglutinin__InfluenzaA__AFM71720
augaagacuaucauugcuuugagcuacauuuucugucugguuuucgcccaaaaacuucccggaaaugacaacagcacagcaacgcugugccugggacaucaugcagugccaaacggaacgcuagugaaaacaauaacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucacucagagugggggaagcuaugcuugcaaaaggggaucuguuaacaguuucuucaguagauugaauugguugcacgaaucagaauacaaauauccagcgcugaacguggcuaugccaaacaauggcaaauuugacaaauuguacauuugggggguucaccacccgaucacggacagagaacaaaccaaccuauauguucgagcaucagggagagucacagucucuaccaagagaagccagcaaacuguaaucccgaauaucgggucuagacccuggguaaggggucuguccaguagaauaagcaucuauuggacaauaguaaaaccgggagacauacuguuuauuaauagcaccgggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39585 - RNA, 1701 nt, Artificial Sequence
  hemagglutinin__InfluenzaA__AFM71731
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagaguggggaaagcuaugcuugcaaaaggggaucuguuaaaaguuucuuuaguagauugaauugguugcacaaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucaauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39586 - RNA, 1701 nt, Artificial Sequence
  hemagglutinin__InfluenzaA__AFM71754
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuucccguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugcccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39587 - RNA, 1701 nt, Artificial Sequence
  hemagglutinin__InfluenzaA__AFM71768
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugaugacuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuucccguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugcccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39588 - RNA, 1701 nt, Artificial Sequence
  hemagglutinin__InfluenzaA__AFM71791
augaagacuaucauugcuuugagcuacacucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuucccguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugagcuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39589 - RNA, 1701 nt, Artificial Sequence
  hemagglutinin__InfluenzaA__AFM71824
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaagacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuucccguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39590 - RNA, 1701 nt, Artificial Sequence
  hemagglutinin__InfluenzaA__AFM71835
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcagcuguuacccuuaugaugugccggauuaugccucccuuaggucacuaguugccucauccggcacacuggaauuuaacagugaaagcuucaauuggacuggagucacucaaaacggaacaagcucugcuugcauaaggagaucuuauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuucccguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauauuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcagagcuucuuguugcccuugagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuucccuugccauaucauguuuuuugcuuuguguugcuuuguugggguucaucaugugggccugccaaaaaggcaacauuaggugcaacauuugcauuuga

SEQ ID NO: 39591 - RNA, 1698 nt, Artificial Sequence
  hemagglutinin__InfluenzaA__AFM71846
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcugaaaaauucuuaugugaacaaaaaagggaaagaaguccuuguacugugggguauucaucacccgucuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 39592 - RNA, 1701 nt, Artificial Sequence; identical to SEQ ID NO: 32822
  hemagglutinin__InfluenzaA__AFM71857

SEQ ID NO: 39593 - RNA, 1701 nt, Artificial Sequence
  hemagglutinin__InfluenzaA__AFM71868
augaagacuaucauugcuuugagcuacauucuaugucugguuuucgcccaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugauguaccggauuaugccucccuuaggucacuaguugccucauccggcacacuggaguuuaacaaugaaagcuucaauuggacuggagucacucaaaauggaacaagcucuucuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccgguuacggacaaugaccaaaucagacuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaaacugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 39594 - RNA, 1701 nt, Artificial Sequence; identical to SEQ ID NO: 37502
  hemagglutinin__InfluenzaA__AFM71879

SEQ ID NO: 39595 - RNA, 1701 nt, Artificial Sequence
  hemagglutinin__InfluenzaA__AFM71890
augaaggcaagacuacugguccuguuaugugcacuugcagcuacagaugcagacacaauauguauaggcuaccaugcgaacaacucaaccgacacuguugacacacuacucgagaagaaugugacagugacacauucuguuaaccugcucgaagacagccacaacgggaaacuauguaaauuaaaaggaauagccccacuacaauuggggaaauguaacaucgccggauggcucuugggaaacccagaaugcgacucacugcuuccagcgagaucaugguccuacauuguagaaacaccaaacucugagaauggagcauguuauccaggagauuucaucgacuaugaggaacugaaggagcaauugagcucaguaucaucauuagaaagauucgaaauauuucccaaggaaaguucauggcccaaccacaacacacucaaaggaguaacagcaucaugcucccaugggggaaaaagcaguuuuuacagaaauuugcuauggcugacgaaaacggaggacucauacccaaagcugagcaauuccuaugugaacaauaaagggaaagaaguccuuguacuaugggguguucaucacccgucuagcagugaugagcaacagagucucuaucauaauguaaaugcuuaugucucuguagugucuucaaauuauaacaggagauucaccccggaaauagcugcaagacccaaaguaagaaaucaaccugggaggaugaacuauuacuggaccuugcuagaacccggagacacaauaauauuugaggcaacugguaaucuaauagcaccaugguaugcuuucgcacugaguagaggguuuggguccggcaucaucaccucaaacgcgucaaugcaugaguguaacacgaagugucaaacaccccagggagcuauaaacagcagucucccuuuccagaauauacacccagucacaauaggagagugcccaaaauaugucaggaguaccaaauugaggaugguuacaggacuaagaaacaucccauccauucaauucagaggucuauuuggagccauugcugguuuuauugaggggggauggacuggaaugauagauggaugguaugguuaucaucaucagaaugaacagggaucaggcuaugcagcggaucaaaaaagcacacaaaaugccauuaacgggauuacaaacaaggugaacucuguuaucgagaaaaugaacacucaauucacagcugugaguaaagaauucaacaacuuagaaaaaaggauggaaaauuuaaauaaaaaaguugaugauggauuucuggacauuuggacauauaaugcagaauuguuaguucuacuggaaaaugaaaggacuuuggauuuccacgauuuaaaugugaagaaucuguacgagaaaguaaaaagccaauuaaagaauaaugccaaagaaaucggaaauggguguuuugaguucuaccacaagugugacaauaaaugcauggaaaguguaagaaaugggacuuaugauuauccaaaauauucagaagaaucaaaguugaacagggaaaagauagauggagugaaauuggaaucaauggggguguaucagauucuggcgaucuacucaacugucgccaguucacuggugcuuuuggucucccugggggcaaucaguuucuggauguguucuaaugggucuuugcagugcagaauaugcaucuga

SEQ ID NO: 39596 - RNA, 1701 nt, Artificial Sequence
  hemagglutinin__InfluenzaA__AFM71901
augaaggcaagacuacugguccuguuaugugcacuugcagcuacagaugcagacacaauauguauaggcuaccaugcgaacaacucaaccgacacuguugacacacuacucgagaagaaugugacagugacacauucuguuaaccugcucgaagacagccacaacgggaaacuauguaaauuaaaaggaauagccccacuacaauuggggaaauguaacaucgccggauggcucuugggaaacccagaaugcgacucacugcuuccagcgagaucaugguccuacauuguagaaacaccaaacucugagaauggagcauguuauccaggagauuucaucgacuaugaggaacugaaggagcaauugagcucaguaucaucauuagaaagauucgaaauauuucccaaggaaaguucauggcccaaccacaacacacucaaaggaguaacagcaucaugcucccaugggggaaaaagcaguuuuuacagaaauuugcuauggcugacgaaaacggaggacucauacccaaagcugagcaauuccuaugugaacaauaaagggaaagaaguccuuguacuaugggguguucaucacccgucuagcagugaugagcaacagagucucuaucauaauguaaaugcuuaugucucuguagugucuucaaauuauaacgggagauucaccccggaaauagcugcaagacccaaaguaagaaaucaaccugggaggaugaacuauuacuggaccuugcuagaacccggagacacaauaauauuugaggcaacugguaaucuaauagcaccaugguaugcuuucgcacugaguagaggguuuggguccggcaucaucaccucaaacgcgucaaugcaugaguguaacacgaagugucaaacaccccagggagcuauaaacagcagucucccuuuccagaauauacacccagucacaauaggagagugcccaaaauaugucaggaguaccaaauugaggaugguuacaggacuaagaaacaucccauccauucaauucagaggucuauuuggagccauugcugguuuuauugaggggggauggacuggaaugauagauggaugguaugguuaucaucaucagaaugaacagggaucaggcuaugcagcggaucaaaaaagcacacaaaaugccauuaacgggauuacaaacaaggugaacucuguuaucgagaaaaugaacacucaauucacagcugugaguaaagaauucaacaacuuagaaaaaaggauggaaaauuuaaauaaaaaaguugaugauggauuucuggacauuuggacauauaaugcagaauuguuaguucuacuggaaaaugaaaggacuuuggauuuccaugaucuaaaugugaagaaucuguacgagaaaguaaaaagccaauuaaagaauaaugccaaagaaaucggaaauggguguuuugaguucuaccacaagugugacaauaaaugcauggaaaguguaagaaaugggacuuaugauuauccaaaauauucagaagaaucaaaguugaacagggaaaagauagauggagugaaauuggaaucaauggggguguaucagauucuggcgaucuacucaacugucgccaguucacuggugcuuuuggucucccugggggcaaucaguuucuggauguguucuaaugggucuuugcagugcagaauaugcaucuga

SEQ ID NO: 39597 - RNA, 1701 nt, Artificial Sequence
  hemagglutinin__InfluenzaA__AFM71923
augaagacuaucauugcuuugagcuacauuuucugucugguucucggccaagaucuuccaggaaaugacaacagcacagcaacgcugugccugggacaucaugcggugccaaacggaacacuagugaaaacaaucacaaaugaucagauugaagugacuaaugcuacugagcugguucagagcuccucaacggggaaaauaugcaacaauccucaucgaauccuugauggaauagacugcacacugauagaugcucuauugggggacccucauugugauagcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaggguuucacuuggacuggggucacucagaaugggggaagcaaugcuugcaaaaggggaccugauagcgguuuuuucaguagacugaacugguuguacaaaucaggaagcacauauccagugcugaacgugacuaugccaaacaaugacaauuuugacaaacuauacauuugggggguucaccacccgagcacgaaccaagaacaaaccagccuauauguucaagcaucagggagagucacagucucuaccaagagaagccagcaaacuauaaucccgaauaucgggucuagacccuggguaaggggucugucuaguagaauaagcaucuauuggacaauaguuaaaccgggagacauacugguaauuaauaguaaugggaaccuaauugcuccucgggguuauuucaaaaugcgcacugggaaaagcucaauaaugaggucagaugcaccuauugguaccuguauuucugaaugcaucacuccaaauggaagcauucccaaugacaaacccuuucaaaacguaaacaagaucacauauggggcaugucccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaagcuguuugaaaaaacaaggaggcaacugagggaaaaugcugaggacaugggcaaugguugcuucagaauauaccacaaaugugacaaugcuugcauagggucaaucagaaaugggacuuaugaccaugauguauacagagacgaagcauuaaacaaccgguuucagaucaaagguguugaacugaaaucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39598 - RNA, 1701 nt, Artificial Sequence
  hemagglutinin__InfluenzaA__AFM71934
augaagacuaucauugcuuugagcuacauuuucugucugguucuaggccaagaucuuccaggaaaugacaacagcacagcaacgcugugccugggacaucaugcggugccaaacggaacacuagugaaaacaaucacaaaugaucagauugaagugacuaaugcuacugagcugguucagagcuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaggguuucacuuggacuggggucacucagaaugggggaagcaaugcuugcaaaaggggaccugauagcgguuuuuucaguagacugaacugguuguacaaaucaggaagcacauauccagugcugaacgugacuaugccaaacaaugacaauuuugacaaacuauacauuugggggguucaccacccgagcacgaaccaagaacaaaccagccuauauguucaagcaucagggagagucacagucucuaccaagggaagccagcaaacuauaaucccgaauaucgggucuagacccuggguaaggggucugucuaguagaauaagcaucuauuggacaauaguuaaaccgggagacauacugguaauuaauaguaaugggaaccuaauugcuccucgggguuauuucaaaaugcgcacugggaaaagcucaauaaugaggucagaugcaccuauugguaccuguauuucugaaugcaucacuccaaauggaagcauucccaaugacaaacccuuucaaaacguaaacaagaucacauauggggcaugucccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaagcuguuugaaaaaacaaggaggcaacugagggaaaaugcugaggacaugggcaaugguugcuucagaauauaccacaaaugugacaaugcuugcauagggucaaucagaaaugggacuuaugaccaugauguauacagagacgaagcauuaaacaaccgguuucagaucaaagguguugaacugaaaucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39599 - RNA, 1701 nt, Artificial Sequence
  hemagglutinin__InfluenzaA__AFM71945
augaagacuaucauugcuuugagcuacauuuucugucugguucucggccaagacuuuccaggaaaugacaacagcacagcaacgcugugccugggacaucaugcggugccaaacggaacacuagugaaaacaaucacaaaugaucagauugaagugacuaaugcuacugagcugguucagaguuccucaacggguaaaauaugcaacaauccucaucgaauccuugauggaauaaacugcacacugauagaugcucuguugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaaggcuucacuuggacuggggucacucagaaugggggaagcaaugcuugcaaaaggggaccugauagcgguuuuuucaguagacugaacugguuguacaaaucaggaagcgcauauccagugcugaacgugacuaugccaaacaaugacaauuuugacaaacuauacauuugggggguucaccacccgagcacggaccaagaacaaaccaaccuauauguucaagcaucagggagagucacagucuccacaaagagaagccagcaaacuauaaucccgaauaucgggucuagacccuggguaaggggucugucuaguagaauaagcaucuauuggacaauaguuaaaccgggagacauacugguaauuaauaguaaugggaaccuaauugcuccucgggguuacuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39600 - RNA, 1701 nt, Artificial Sequence; identical to SEQ ID NO: 39599
  hemagglutinin__InfluenzaA__AFM71956

SEQ ID NO: 39601 - RNA, 1704 nt, Artificial Sequence
  hemagglutinin__InfluenzaA__AFM71978
augaagacuaucauugcuuugagcuacauuuucugucugguuuucgcccaagaccuuccaggaaaugacaacaacagcacagcaacgcugugccugggacaucaugcggugccaaacggaacgcuagugaaaacaaucacgaaugaucagauugaagugacuaaugcuacugagcugguucagaguuccucaacggguaaaauaugcaacaauccucaucgaauccuugauggaauaaacugcacacugauagaugcucuauugggggacccucauugugauggauuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcaaugcuugcaaaagaggaccugauagcgguuuuuucaguagacugaacugguuguacaaaucaggaagcacauauccagugcaaaacgugaccaugccaaacaaugacaauucugacaaacuauacauuugggggguucaccacccgagcacggacaaagaacaaaccaaccuauauguucaagcaucagggaaagucacagucuccaccaagagaagccagcaaacuauaaucccgaaugucgggucuagacccuggguaaggggucugucuaguagaauaagcaucuauuggacaauaguuaaaccgggagacauacugguaauuaauaguaaugggaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauuccgagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39602 - RNA, 1701 nt, Artificial Sequence
  hemagglutinin__InfluenzaA__AFM71989
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccgaguacggacaaggaccaaaucuuccuguauacucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaauuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39603 - RNA, 1701 nt, Artificial Sequence
  hemagglutinin__InfluenzaA__AFM72010
augaagacuaucauugcuuugagcuacauuuucugucagguucucgcccaaaaccuuccaggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaucgaauccuugaugggaaaaacugcacacugauagaugcucuauugggggacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuaucaaugaaggcuucaauuggacuggggucacucagaaugggggaagcuaugcuugcaaaaggggaccugauaaaaguuucuucaguagacugaacugguuguacgaaucagaaagcacauauccagugcugaacgugacuaugccaaacaaugacaauuuugacaaacuguacauuuggggaguucaccacccgagcacggacaaagaacaaaccaaacuauauguucaagcaucagggagagucacagucuccaccaagagaagccagcaaacuauaaucccgaaugucgggucuagacccuggguaaggggucugucuaguagaauaagcaucuauuggacaauaguaaaaccgggagacauacuguuaauuaauaguaaugggaaccuaauugcuccucgggguuacuucaaaauacgcacugggaaaagcucaauaaugaggucagaugcacccauuggcaccugcaguucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaaaacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 39604 - RNA, 1701 nt, Artificial Sequence; identical to SEQ ID NO: 31420
  hemagglutinin__InfluenzaA__AFM72021

SEQ ID NO: 39605 - RNA, 1701 nt, Artificial Sequence
  hemagglutinin__InfluenzaA__AFM72032
augaagacuaucauugcuuugagcuacauguucugucugguuuucgcccaaaaccuucccggaaaugacaacagcacagcaacgcugugccugggacaucaugcagugccaaacggaacgcuagugaaaacaaucacgaaugaucagauugaagugacuaaugcuacugagcugguucagaguuccucaacagguaggauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccagauuaugccucccuuaggucacuaguugccucaucaggcacccuggaguuuaucaaugaaggcuucaauuggacuggagucacucagagugggggaagcuauacuugcaaaaggggaucuaauaacaguuucuucaguagacugaacugguuguacgaaucagaaagcaaauauccagugcugaacgugacuaugccaaacaauggcaaauuugacaaauuguacauuugggggauucaccacccgagcacggacaaagaacaaaccaaccuauauauucgagcaucagggagagucacagucucuaccaagagaagccagcaaacuguaaucccgaauaucgggucuagacccuggguaaggggucugucuaguagaauaaguaucuauuggacaauaguaaaaccgggagacauacuguuaauuaauagcacugggaaccuaauugcuccucgggguuacuucaaaauacgcacugggaaaagcucaauaaugaggucagaugcaccuauuggcaccugcaguucugaaugcaucacuccaaauggaagcauucccaaugacaagcccuuucaaaacguaaacaagaucacauauggggcaugucccagguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcucuggagaaccaacauacaauugaucugacugacucagaaaugaacaaacuguuugaaaaaacaaggaaacaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39606 - RNA, 1701 nt, Artificial Sequence
  hemagglutinin__InfluenzaA__AFM72043
augaagacuaucauugcuuugagcuacauguucugucugguuuucgcccaaaaccuucccggaaaugacaacagcacagcaacgcugugccugggacaucaugcagugccaaacggaacgcuagugaaaacaaucacgaaugaucagauugaagugacuaaugcuacugagcugguucagaguuccucaacagguaggauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccagauuaugccucccuuaggucacuaguugccucaucaggcacccuggaguuuaucaaugaaggcuucaauuggacuggagucacucagagugggggaagcucuacuugcaaaaggggaucuaauaacaguuucuucaguagacugaacugguuguacgaaucagaaagcaaauauccagugcugaacgugacuaugccaaacaauggcaaauuugacaaauuguacauuugggggauucaccacccgagcacggacaaagaacaaaccaaccuauauauucgagcaucagggagagucacagucucuaccaagagaagccagcaaacuguaaucccgaauaucgggucuagacccuggguaaggggucugucuaguagaauaaguaucuauuggacaauaguaaaaccgggagacauacuguuaauuaauagcacugggaaccuaauugcuccucgggguuacuucaaaauacgcacugggaaaagcucaauaaugaggucagaugcaccuauuggcaccugcaguucugaaugcaucacuccaaauggaagcauucccaaugacaagcccuuucaaaacguaaacaagaucacauauggggcaugucccagguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcucuggagaaccaacauacaauugaucugacugacucagaaaugaacaaacuguuugaaaaaacaaggaaacaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39607 - RNA, 1701 nt, Artificial Sequence
  hemagglutinin__InfluenzaA__AFM72054
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcagcaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuccuggacauuuggacauauaaugcagaauuguugguucuacuggaaaaugaaaggacuuuggauuuccaugacucaaaugugaagaacuuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 39608 - RNA, 1701 nt, Artificial Sequence; identical to SEQ ID NO: 39607
  hemagglutinin__InfluenzaA__AFM72065

SEQ ID NO: 39609 - RNA, 1701 nt, Artificial Sequence
  hemagglutinin__InfluenzaA__AFM72087
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuauugaacgcagcaaagcuuucagcaacuguuacccuuaugaugugccggauuaugccucccuuaggucacuaguugccucaucaggcacccuggaguuuaucaaugaaggcuucaauuggacuggagucacucagagugggggaagcuauacuugcaaaaggggaucuguuaacaguuucuucaguagauugaauugguuguacgaaucagaauacaaauauccagcgcugaacgugacuaugccaaacaauggcaaauuugacaaauuguacauuugggggguucaccacccgagcacggaaaaagaacaaaccaaccuauauguucgagcaucagggagagucacagucucuaccaagagaagccagcaaacuguaaucccgaauaucgggucuaguccauggguaaggggucuguccaguagaauaagcaucuauuggacaauaguaaaaccgggagacauacuguugauuaauagcacugggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguaugucaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaagcugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaauauacaauugaucugacugacucagaaaugaacaaacuguuugaaaaaacaaggaagcaacugagggaaaaugcugaggacaugggcaaugguugcuucaaaauauaccacaaaugugacaaugcuugcauagggucaaucagaaaugggacuuaugaccaugauguauacagagacgaagcauugaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39610 - RNA, 1701 nt, Artificial Sequence
  hemagglutinin__InfluenzaA__AFM72098
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucacucagagugggggaagcuaugcuugcaaaaggggaucuguuaacaguuucuucaguagauugaauugguuguacaaaucagaauacaaauauccagcgcugaacgugacuaugccaaacaauggcaaauuugacaaauuguacauuugggggguucaccacccggucacggacagagaacaaaccaaccuauauguucgagcaucagggagagucacagucucuaccaagagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagauauguuaagcaaaacacucugaaauuggcaacagggaugcggaauguaccagagaaacaaacuagaggcauauucggcgcaauagcagguuucauagaaaaugguugggagggaaugguagacggcugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39611 - RNA, 1701 nt, Artificial Sequence
  hemagglutinin__InfluenzaA__AFM72109
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucacucagagugggggaagcuaugcuugcaaaaggggaucuguuaacaguuucuucaguagauugaauugguugcacaaaucagaauacaaauauccagcgcugaacgugacuaugccaaacaauggcaaauuugacaaauuguacauuugggggguucaccacccgaucacggacagagaacaaaccaaccuauauguucgagcaucagggagagucacagucucuaccaagagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagauauguuaagcaaaacacucugaaauuggcaacagggaugcggaauguaccagagaaacaaacuagaggcauauucggcgcaauagcagguuucauagaaaaugguugggagggaaugguagacggcugguacgguuucaggcaucaaaauucugagggcacaggacaagcagcagaucuuaaaagcacucaagcagcaaucgaccaaaucaacggaaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaggcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39612 - RNA, 1701 nt, Artificial Sequence
  hemagglutinin__InfluenzaA__AFM72120
augaagacuaucauugcuuugagcuacauuuucugucugguuuucgcccaaaaacuucccggaaaugacaacagcacagcaacgcugugccugggacaucaugcagugccaaacggaacgcuagugaaaacaauaacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucacucagagugggggaagcuaugcuugcaaaaggggaucuguuaacaguuucuucaguagauugaauugguugcacgaaucagaauacaaauauccagcgcugaacgugacuaugccaaacaauggcaaauuugacaaauuguacauuugggggguucaccacccgaucacggacagagaacaaaccaaccuauauguucgagcaucagggagagucacagucucuaccaagagaagccagcaaacuguaaucccgaauaucggguuuagacccuggguaaggggucuguccaguagaauaagcaucuauuggacaauaguaaaaccgggagacauacuguugauuaauagcaccgggaaccuaauugcuccucgggguuacuucaaaauacgcaaugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 39613 - RNA, 1701 nt, Artificial Sequence
  hemagglutinin__InfluenzaA__AFM72131
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaagacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggaauggagucgcucagaguggggaaagcuaugcuugcaaaaggggaucuguuaaaaguuucuuuaguagauugaauugguugcacgaaucagaauacaaauauccagcgcugaacgugacuaugccaaacaauggcaaauuugacaaauuguacauuugggggguucaccacccgagcacggacagagaacaaaccaaacuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcaccgggaaccuaauugcuccucgggguuacuucaaaauacgaacugggaaaagcucaauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39614 - RNA, 1701 nt, Artificial Sequence
  hemagglutinin__InfluenzaA__AFM72142
augaagacuaucauugcuuugagcuacauuucaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugagcugguacagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggaccgugaccaaaccagccuauauguucgagcaucagggagagucacagucucuaccaaaagaagccaacaaacuguaaucccgaauaucgggucuagacccuggguaaggggucaguccaguagaauaagcaucuauuggacaauaguaaaaccgggagacauacuuuugauuaauagcacagggaaucuaauugcuccucgggguuacuucaaaauacgaaaugggaaaagcucaauaaugagaucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagaugguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuucuugcuuuguguuguuuugcugggguucaucaugugggccugccaaaaaggcaacauuaggugcaacauuugcauuuga

SEQ ID NO: 39615 - RNA, 1701 nt, Artificial Sequence
  hemagglutinin__InfluenzaA__AFM72153
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugaguugguucagaguuccucaacagguagaauaugcggcaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcaaaagaggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaccccgaauaucgggucuagacccuggguaaggggucaguccaguagaauaggcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacagaaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaauugaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39616 - RNA, 1701 nt, Artificial Sequence
  hemagglutinin__InfluenzaA__AFM72164
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggagagucacagucucuaccaaaagaagccaacaaacuguaaucccggauaucggguauagaccauggguaaggggucaguccaguagaauaagcauccauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuguuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauucuauggauuuccuuugccauaucaugcuuuuugcuuuguguuguuuugcuuggguucaucaugugggccugccaaaaaggcaacauuaggugcaacauuugcauuuga

SEQ ID NO: 39617 - RNA, 1701 nt, Artificial Sequence
  hemagglutinin__InfluenzaA__AFM72175
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccaaccuauauguccgagcaucagggagagucacagucucuaccaaaagaagccaacaaacuguaaucccggauaucggguauagaccauggguaaggggucaguccaguagaauaagcauccauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuguuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauucuauggauuuccuuugccauaucaugcuuuuugcuuuguguuguuuugcuuggguucaucaugugggccugccaaaaaggcaacauuaggugcaacauuugcauuuga

SEQ ID NO: 39618 - RNA, 1701 nt, Artificial Sequence
  hemagglutinin__InfluenzaA__AFM72197
augaagacuaucauugcuuugagcuacauuuuauguaugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgauuacggacagugaacaaaccagcuuauauguucaagcaucagggagagucacagucucuaccaaaagaagccaacaaacuguaaucccgaauaucggauauagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauuccuaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaagggcaacauuaagugcaacauuugcauuuga

SEQ ID NO: 39619 - RNA, 1701 nt, Artificial Sequence
  hemagglutinin__InfluenzaA__AFM72208
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacugauagaugcucuauugggagacccacauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaacaguuucuuuaguagauugaauugguugcaccaauuaaaauacagauauccagcacugaacgugacuaugccaaacaaugacaaauuugacaaauuguacauuugggggguucaccacccgaguacggacagugaccaaaccagccuauauacccaagcaucagggagagucacagucucuaccaaaagaagccaacaaacuguaaucccgaauaucggauccagacccuggguaagggguaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugauggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagagaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucauuaugugggccugccaaaaaggcaacauuaggugcaacauuugcauuuga

SEQ ID NO: 39620 - RNA, 1701 nt, Artificial Sequence
  hemagglutinin__InfluenzaA__AFM72219
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacugauagaugcucuauugggagacccacauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaacaguuucuuuaguagauugaauugguugcaccaauuaaaauacagauauccagcacugaacgugacuaugccaaacaaugacaaauuugacaaauuguacauuugggggguucaccacccgaguacggacagugaccaaaccagccuauauacccaagcaucagggagagucacagucucuaccaaaagaagccaacaaacuguaaucccgaauaucggauccagacccuggguaagggguaucuccagcagaauaagcaucuauuggacaauaguaaaaccgggagacauacuuuugauuaaaagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugauggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagagaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucauuaugugggccugccaaaaaggcaacauuaggugcaacauuugcauuuga

SEQ ID NO: 39621 - RNA, 1698 nt, Artificial Sequence
  hemagglutinin__InfluenzaA__AFM72230
augaaagcaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaagaaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuauguaaacaacaaagagaaagaaguccuuguacuaugggguguucaucacccgccuaacauagggaaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaaccuggggauacaauaauauuugaggcaaauggaaaucuaauagcgccaugguaugcuuuugcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaaguacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 39622 - RNA, 1701 nt, Artificial Sequence
  hemagglutinin__InfluenzaA__AFM72246
augaagacuaucauugcuuugagcuacauuuuaugucugguuuucgcucaaaaacuucccggaaaugacaacagcacggcaacgcugugccuggggcaccaugcagugucaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagcauauaugcucaagcaucagggagagucacagucucuaccaaaagaagccaacaaacuguaaucccgaauaucggaucuagccccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 39623 - RNA, 1701 nt, Artificial Sequence
  hemagglutinin__InfluenzaA__AFM72257
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaauuacaaauauccagcacugaacgugacuaugccaaacaaugaaaaauuugacaaauuguacauuugggggguucaccacccgaguacggacagugaccaaaucagcauauaugcucaagcaucagggagagucacagucucuaccaaaagaagccaacaaacuguaaucccgaauaucggaucuagacccuggguaaggggugucuccagcggaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39624 - RNA, 1701 nt, Artificial Sequence
  hemagglutinin__InfluenzaA__AFM72268
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaauuacaaauauccagcacugaacgugacuaugccaaacaaugaaaaauuugacaaauuguacauuugggggguucaccacccgaauacggacagugaccaaaucagcauauaugcucaagcaucagggagagucacagucucuaccaaaagaagccaacaaacuguaaucccgaauaucggaucuagacccuggguaaggggugucuccagcggaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucuauggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39625 - RNA, 1701 nt, Artificial Sequence
  hemagglutinin__InfluenzaA__AFM72279
augaagacuaucauugcuuugagcuacauuuuaugucugguuuucgcucaaaaacuucccguaaaugacaacagcacggcaacgcugugccugggacaccaugcagugccuaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagcauauaugcucaagcaucagggagagucacagucucuaccaaaagaagccaacaaacuguaaucccgaauaucggaucuaaacacuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuucagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39626 - RNA, 1701 nt, Artificial Sequence
  hemagglutinin__InfluenzaA__AFM72290
augaagacuaucauugcuuugagcuacauuuuaugucugguuuucgcucaaaaacuucccguaaaugacaacagcacggcaacgcugugccugggacaccaugcagugccuaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaagacaaauauccagcacugaacgugacuaugccaaacaaugaaaaauuugacaaauuguacauuugggggguucaccacccgaguacggacagugaccaaaucagcauauaugcucaagcaucagggagagucacagucucuaccaaaagaagccaacaaacuguaaucccgaauaucggaucuaaacacuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuucagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 39627 - RNA, 1701 nt, Artificial Sequence
  hemagglutinin__InfluenzaA__AFM72301
augaagacuaucauugcuuuaagcuacauucuaugucugguuuucucucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucagaauggaacaagcucugcuugcaaaaggagaucuaauaaaaguuucuuuaguagauugaauugguugacccaauuaaaauacaaauacccagcauugaacgugacuaugccaaacaaugaaaaauuugacaaauuguacauuugggggguucaccacccgguuacggacagugaccaaaucagccuauaugcucaagcaucaggaagaaucacagucucuaccaaaagaagccaacaaacuguaaucccgaauaucggauauagacccaggguaagggauaucuccagcagaauaagcaucuauuggacaauaguaaaaccgggagacauacuuuugauuaacagcacaggaaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggaaaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagagucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39628 - RNA, 1701 nt, Artificial Sequence
  hemagglutinin__InfluenzaA__AFM72312
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccgguuacggacagugaccaaaucaaccuauaugcucaagcaucaggaagaaucacaguuucuaccaaaagaagccaacaaacuguaaucccgaauaucggauauagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugagugcaucacuccaaauggaagcauucccaaugacaaaccauuucaaaauguaaacaggaucacauauggggccugucccagauauguuaagcaaaacacucugaaauuggcaacagggaugcgaaauguaccagagaaacagacuagaggcauauuuggcgcaaucgcggguuucauagaaaaugguugggagggaaugguggacgguugguacgguuucaggcaucaaaauucugagggcacaggacaagcagcagaucucaaaagcacccaagcagcaaucaaccaaaucaaugggaaacugaauagguuaaucgggaaaacaaacgaaaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggacaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39629 - RNA, 1701 nt, Artificial Sequence
  hemagglutinin__InfluenzaA__AFM72323
augaaggcuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccgguuacggacagugaccaaaucaaccuauaugcucaagcaucaggaagaaucacaguuucuaccaaaagaagccaacaaacuguaaucccgaauaucggauauagacccaggguaagggauaaccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugagugcaucacuccaaauggaagcauucccaaugacaaaccauuucaaaauguaaacaggaucacauauggggccugucccagauauguuaagcaaaacacucugaaauuggcaacagggaugcgaaauguaccagagaaacagacuagaggcauauuuggcgcaaucgcggguuucauagaaaaugguugggagggaaugguggacgguugguacgguuucaggcaucaaaauucugagggcacaggacaagcagcagaucucaaaagcacccaagcagcaaucaaccaaaucaaugggaaacugaauagguuaaucgggaaaacaaacgaaaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggacaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39630 - RNA, 1701 nt, Artificial Sequence
  hemagglutinin__InfluenzaA__AFM72334
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucuccacccggguacguacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuucaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39631 - RNA, 1701 nt, Artificial Sequence
  hemagglutinin__InfluenzaA__AFM72345
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccgguuacggacagugaccaaaucagccuauauacucaagcaucaggaagaaucacagucucuaccaaaagaagccaacaaacuguaaucccgaauaucggauuuagacccaggguaagggauaucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39632 - RNA, 1701 nt, Artificial Sequence
  hemagglutinin__InfluenzaA__AFM72356
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucaaccuauauguucaagcaucaggaagaaucacagucucuaccaaaagaagccaacaaacuguaaucccgaauaucggaucuagacccagaguaagggauguccccagcagaauaagcaucuauuggacaauaguaaaaccgggagacauacuuuugauuagcagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39633 - RNA, 1701 nt, Artificial Sequence
  hemagglutinin__InfluenzaA__AFM72367
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccgguuacggacaaugaccaaaucaaccuauaugcucaagcaucaggaagaaucacagucucuaccaaaagaagccaacaaacuguaaucccgaauaucggaucuagacccagaguaagggauguccccagcagaauaagcaucuauuggacaauaguaaaaccgggagacauacuuuugauuagcagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucuaaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39634 - RNA, 1701 nt, Artificial Sequence
  hemagglutinin__InfluenzaA__AFM72378
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccaauuaaacuucaaauacccagcauugaacgugacuaugccaaacaaugaacaauuugacaaauuguacauuugggggguucaccacccgguuacggacaaggaccaaaucuuccuguaugcucaagcaucaggaagaaucacaguaucuaccaaaagaagccaacaagcuguaauuccgaauaucggauauagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaggcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39635 - RNA, 1701 nt, Artificial Sequence
  hemagglutinin__InfluenzaA__AFM72389
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccgguuacggacaaggaccaaaucuuccuguaugcucaagcaucaggaagaaucacaguaucuaccaaaagaagccaacaagcuguaauuccgaauaucggauauagacccagaguaaggaauaacccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaggcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39636 - RNA, 1701 nt, Artificial Sequence
  hemagglutinin__InfluenzaA__AFM72400
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucuccacccggguacggacaaugaccaaaucuuccuguaugcucaagcaucaggaagaaucacagucucuaccaaaagaagccaacaaacuguaaucccgaauaucggaucuagacccagaguaaggaauauucccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39637 - RNA, 1701 nt, Artificial Sequence
  hemagglutinin__InfluenzaA__AFM72411
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucaaaauggaacaagcucugcuugcaaaaggggaucuaauaacaguuucuuuaguagauugaauugguugacccaaucaaaauucaaauacccagcauugaacgugacuaugccaaacaaugaagaauuugacaaauuguacauuugggggguucaccacccgguuacggacaaugaccaaaucuuccuguaugcucaagcaucaggaagaaucacagucucuaccaaaagaagccaacaaacuguaaucccgaauaucggaucuagacccagaguaaggaauauucccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggacuucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39638 - RNA, 1701 nt, Artificial Sequence
  hemagglutinin__InfluenzaA__AFM72422
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaagaauuugacaaauuguacauuugggggguucaccacccgguuacggacaaugaccaaaucuuccuguaugcucaagcaucaggaagaaucacagucucuaccaaaagaagccaacaaacuguaaucccgaauaucggauuuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauaugcugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39639 - RNA, 1701 nt, Artificial Sequence
  hemagglutinin__InfluenzaA__AFM72433
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaagaauuugacaaauuguacauuugggggguucaccacccgguuacggacaaugaccaaaucuuccuguaugcucaagcaucaggaagaaucacagucucuaccaaaagaagccaacaaacuguaaucccgaauaucggauuuagacccagaguaaggaauaaccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauaugcugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39640 - RNA, 1701 nt, Artificial Sequence
  hemagglutinin__InfluenzaA__AFM72444
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaagaauuugacaaauuguacauuugggggguucaccacccgguuacggacaaugaccaaaucuuacuguaugcucaagcaucaggaagaaucacaguaucuaccaaaagaagccaacaaacuguaaucccgaauaucggauuuagacccagaguaaggaauaaccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauaugcugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39641 - RNA, 1701 nt, Artificial Sequence
  hemagglutinin__InfluenzaA__AFM72455
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccaauuaaaauucaaauacccagcauugaacgugacuaugccaaacaaugaagaauuugacaaauuguacauuugggggguucaccacccgguuacggacaaugaccaaaucuuccuguaugcucaagcaucaggaagaaucacagucucuaccaaaagaagccaacaaacuguaaucccgaauaucggauuuagacccagaguaaggaauaaccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauaugcugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39642 - RNA, 1701 nt, Artificial Sequence
  hemagglutinin__InfluenzaA__AFM72466
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaagaauuugacaaauuguacauuugggggguucaccacccgguuacggacaaagaccaaaucuuccuguaugcucaagcaucaggaagaaucacagucucuaccaaaagaagccaacaaacuguaaucccgaauaucggauuuagacccagaguaaggaauaaccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauaugcugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39643 - RNA, 1701 nt, Artificial Sequence
  hemagglutinin__InfluenzaA__AFM72488
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccaauuaaaauucaaauacccagcauugaacgugacuaugccaaacaaugaaaaauuugacaaauuguacauuugggggguucaccacccgguuacggacaaugaacaaaucuuccuguaugcucaagcaucaggaagaaucacagucucuaccaaaagaagucaacaaacuguaaucccgaauaucggauuuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuaaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaaugagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugauuuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39644 - RNA, 1701 nt, Artificial Sequence
  hemagglutinin__InfluenzaA__AFM72499
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccaauuaaaauucaaauacccagcauugaacgugacuaugccaaacaaugaaaaauuugacaaauuguacauuugggggguucaccacccgguuacggacaaugaccaaaucuuccuguaugcucaagcaucaggaagaaucacagucucuaccaaaagaagucaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaaugagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugauuuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39645 - RNA, 1698 nt, Artificial Sequence
  hemagglutinin__InfluenzaA__AFM72521
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaagacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucacuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguaaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacugaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39646 - RNA, 1698 nt, Artificial Sequence
  hemagglutinin__InfluenzaA__AFM72532
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaagacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucacuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguaaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39647 - RNA, 1698 nt, Artificial Sequence; identical to SEQ ID NO: 39646
  hemagglutinin__InfluenzaA__AFM72543

SEQ ID NO: 39648 - RNA, 1698 nt, Artificial Sequence
  hemagglutinin__InfluenzaA__AFM72554
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaagacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucacuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguaaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguugaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugaugaagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39649 - RNA, 1701 nt, Artificial Sequence
  hemagglutinin__InfluenzaA__AFM72565
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucuucuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuucccguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugggagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaggaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39650 - RNA, 1701 nt, Artificial Sequence
  hemagglutinin__InfluenzaA__AFM72576
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucuucuugcauaaggggaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuucccguaugcucaagcaucaggaagaaucacagucucuaccaaaagaagccaacaaaccguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugggagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaggaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39651 - RNA, 1698 nt, Artificial Sequence
  hemagglutinin__InfluenzaA__AFM72799
augaaaguaaaacuacugguccuauuaugcacauuuacagcuacauaugcggacacaauauguaucggcuaccaugccaacaacucaaccgacacuguugacacaguacuugaaaagaaugugacagugacacacucugucaaccugcuugaggacaaccacaauggaaaacuaugucuauuaaaaggaaaagccccauuacaauuggguaacugcagcguugccggguggaucuuaggaaacccagaaugcggauuacugauuuccaaggagucaugguccuacauuguagaaagaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaacggggaaagcagcuuuuacaaaaauuugcuauggcugacgggaaagaaugguuuguacccaaaccugagcaaguccuaugcaaacaacaaagagaaagaaguccucguacuaugggguguucaucacccgccaaacauagguaaccaaaugacccucuaucauaaagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaaugggaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaacucuguaauugagaagaugaacacucaauucacagcuguaggcaaagaauucaacaaauuggaaagaaggauggaaaacuuaaauaaaaaaguugaugacggguuuauagacguuuggacauauaaugcagaacuguugguucuacuggaaaaugaaaggacuuuggauuuccaugacuccaaugugaagaauuuguaugagaaaguaaaaaaccaauuaaaaaauaaugccaaagaaauaggaaauggguguuuugaauuuuaucacaaguguaacgaugaaugcauggagaguguaaaaaauggaacuuaugauuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 39652 - RNA, 1698 nt, Artificial Sequence; identical to SEQ ID NO: 39651
  hemagglutinin__InfluenzaA__AFM72810

SEQ ID NO: 39653 - RNA, 1698 nt, Artificial Sequence; identical to SEQ ID NO: 39651
  hemagglutinin__InfluenzaA__AFM72821

SEQ ID NO: 39654 - RNA, 1701 nt, Artificial Sequence
  hemagglutinin__InfluenzaA__AFM72852
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucggacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagacguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39655 - RNA, 1701 nt, Artificial Sequence
  hemagglutinin__InfluenzaA__AFM72862
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaacuccuacauuaaugauaaagggaaagaaguccucgugcuauggggcauucaccauccaucuacuagugcugaccaacaaagucucuaucagaaugcagaugcauauguuuuuguggggucaucaagauacagcaagacguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39656 - RNA, 1701 nt, Artificial Sequence
  hemagglutinin__InfluenzaA__AFM72872
augaagacuaucauugcuuugagcuacacucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuucccguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39657 - RNA, 1701 nt, Artificial Sequence
  hemagglutinin__InfluenzaA__AFM72883
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacucacuuaaacuucaaauacccagcauugaacgugacuaugccgaacaaugaacaauuugacaaauuguacauuugggggguucaccacccgguuacggacaaagaccaaaucuuccuguaugcucaagcaucaggaagaaucacagucucuaccaaaagaagccaacaaacuguaaucccgaauaucggaucuagaccccgaguaaggaauaucccuaccagaauaagcaucuauuggacaauaguaaaaccgggagacauacuuuugauuaacagcacagggaaucuaauugcuccuagggguuacuucaaaaugcaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39658 - RNA, 1701 nt, Artificial Sequence
  hemagglutinin__InfluenzaA__AFM72894
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacucaauuaaacuucaaauacccagcauugaacgugacuaugccgaacaaugaacaauuugacaaauuguacauuugggggguucaccacccgguuacggacaaagaccaaaucuuccuguaugcucaagcaucaggaagaaucacagucucuaccaaaagaagccaacaaacuguaaucccgaauaucggaucuagaccccgaguaaggaauaucccuagcagaauaagcaucuauuggacaauaguaaaaccgggagacauacuuuugauuaacagcacagggaaucuaauugcuccuagggguuacuucaaaaugcaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39659 - RNA, 1701 nt, Artificial Sequence
  hemagglutinin__InfluenzaA__AFM72916
augaagacuaucauugcuuugagcuacauucuaugucugguuuucgcucaaaaaauuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuucccguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuggaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauugguuccuauggauuuccuuugccauaucauguuuuuugcuuuguguugcuuuguugggguucaucaugugggccugccaaaaaggcaacauuaggugcaacauuugcauuuga

SEQ ID NO: 39660 - RNA, 1701 nt, Artificial Sequence
  hemagglutinin__InfluenzaA__AFM72927
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaaugugacuaugccaaacaaugaacaauuugacaaauuguacauuugggggguucaccacccggguacggacaaugaccaaaccucccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcauagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39661 - RNA, 1701 nt, Artificial Sequence
  hemagglutinin__InfluenzaA__AFM72938
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaaugugacuaugccaaacaaugaacaauuugacaaauuguacauuugggggguucaccacccggguacggacaaugaccaaaccucccuguaugcucaagcaucaggaagaaucacagucucuaccaaaagaagccaacaaacuguaaucccgaauaucggaucuagacccagaguaaggaauaacccuagcagaauaagcaucuauuggacaauaguaaaaccgggagacauacuuuugauuaacagcauagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39662 - RNA, 1701 nt, Artificial Sequence
  hemagglutinin__InfluenzaA__AFM72949
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccaauuaaaauucaaauacccagcauuaaaugugacuaugccaaacaaugaacaauuugacaaauuguacauuugggggguucaccacccggguacggacaaugaccaaaccucccuguaugcucaagcaucaggaagaaucacagucucuaccaaaagaagccaacaaacuguaaucccgaauaucggaucuagacccagaguaaggaauaacccuagcagaauaagcaucuauuggacaauaguaaaaccgggagacauacuuuugauuaacagcauagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39663 - RNA, 1701 nt, Artificial Sequence
  hemagglutinin__InfluenzaA__AFM72960
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaaguggacuggagucacucaaaacggaacaagcucugcuugcauaaggagaucuaauaacaguuucuuuaguagauugaauugguugacccacuuaaaauucaaauacccagcauuaaaugugacuaugccaaacaaugaacaauuugacaaauuguacauuugggggguucaccacccggguacggacaaugaccaaaccucccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcauagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39664 - RNA, 1701 nt, Artificial Sequence
  hemagglutinin__InfluenzaA__AFM72971
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaaguggacuggagucacucaaaacggaacaagcucugcuugcauaaggagaucuaauaacaguuucuuuaguagauugaauugguugacccaauuaaacuucaaauacccagcauuaaaugugacuaugccaaacaaugaacaauuugacaaauuguacauuugggggguucaccacccggguacggacaaugaccaaaccucccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcauagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugauaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39665 - RNA, 1701 nt, Artificial Sequence
  hemagglutinin__InfluenzaA__AFM72982
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaauuuaacagugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuucccguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauauuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcagagcuucuuguugcccuugagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuucccuugccauaucauguuuuuugcuuuguguugcuuuguugggguucaucaugugggccugccaaaaaggcaacauuaggugcaacauuugcauuuga

SEQ ID NO: 39666 - RNA, 1701 nt, Artificial Sequence
  hemagglutinin__InfluenzaA__AFM72993
augaagacuaucauugcuuugagcuacauucuaugucugguuuucgcccaaaaacuuccuggaaaugacaacagcacggcaacgcugugccuugggcaccaugcaguaccaaacggaacgauagugaaaacaaucacgaaugaccaaauagaaguuacuaaugcuacugagcugguucagaguuccucagcaggugaaauaugcgacaguccucaucagauccuugauggagaaaacugcacacuaauagaugcccuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucuccacccggguacguacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39667 - RNA, 1701 nt, Artificial Sequence
  hemagglutinin__InfluenzaA__AFM73004
augaagacuaucauugcuuugagcuacauucuaugucugguuuucgcccaaaaacuuccuggaaaugacaacagcacggcaacgcugugccuugggcaccaugcaguaccaaacggaacgauagugaaaacaaucacgaaugaccaaauagaaguuacuaaugcuacugagcugguucagaguuccucagcaggugaaauaugcgacaguccucaucagauccuugauggagaaaacugcacacuaauagaugcccuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucuccacccggguacguacaaggaccaaaucuuccuguaugcucaagcaucaggaagagucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuuucuuuguguugcuuuguugggguucaucaugugggccugccaaaaaggcaacauuaggugcaacauuugcauuuga

SEQ ID NO: 39668 - RNA, 1701 nt, Artificial Sequence
  hemagglutinin__InfluenzaA__AFM73015
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaucauccaucuacuacugcugaccaacaaagucucuaucagaaugcagauacauauguuuuuguggggacaucaagauacagcaagaaguucaagccggaaauagcaauaagacccaaagugagggaucgagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaauuaaaaaacaaugccaaggaaauuggaaauggcugcuuugaauuuuaccacaaaugcgauaacacgugcauggaaaguguuaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 39669 - RNA, 1701 nt, Artificial Sequence
  hemagglutinin__InfluenzaA__AFM73025
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaucauccaucuacuacugaugaccaacaaagucucuaucagaaugcagauacauauguuuuuguggggacaucaagauacagcaagaaguucaagccggaaauagcaauaagacccaaagugagggaucgagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaauuaaaaaacaaugccaaggaaauuggaaauggcugcuuugaauuuuaccacaaaugcgauaacacgugcauggaaaguguuaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 39670 - RNA, 1701 nt, Artificial Sequence; identical to SEQ ID NO: 39669
  hemagglutinin__InfluenzaA__AFM73035

SEQ ID NO: 39671 - RNA, 1701 nt, Artificial Sequence
  hemagglutinin__InfluenzaA__AFM73045
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguggccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugaaucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39672 - RNA, 1701 nt, Artificial Sequence
  hemagglutinin__InfluenzaA__AFM73055
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguggccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguugaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39673 - RNA, 1701 nt, Artificial Sequence
  hemagglutinin__InfluenzaA__AFM73065
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguggccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaagaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39674 - RNA, 1701 nt, Artificial Sequence; identical to SEQ ID NO: 31420
  hemagglutinin__InfluenzaA__AFM73477

SEQ ID NO: 39675 - RNA, 1707 nt, Artificial Sequence
  hemagglutinin__InfluenzaA__AFM78567
auggagaaaauagugcuucuucuugcaauagucagucuuguuaaaagugaucagauuugcauugguuaccaugcaaacaauucaacagagcagguugacacaaucauggaaaagaacguuacuguuacacaugcccaagacauacuggaaaagacacacaacgggaagcucugcgaucuagauggagugaagccucuaauuuuaagagauuguaguguagcuggauggcuccucgggaacccaaugugugacgaauucaucaauguaccggaauggucuuacauaguggagaaggccaauccaaccaaugaccucuguuacccagggaguuucaacgacuaugaagaacugaaacaccuauugagcagaauaaaccauuuugagaaaauucaaaucauccccaaaaguucuugguccgaucaugaagccucaucaggagugagcucagcauguccauaccugggaagucccuccuuuuuuagaaaugugguauggcuuaucaaaaagaacaguacauacccaacaauaaagaaaagcuacaauaauaccaaccaagaagaucuuuugguacuguggggaauucaccauccuaaugaugcggcagagcagacaaggcuauaucaaaacccaaccaccuauauuuccauugggacaucaacacuaaaccagagauugguaccaaaaauagcuacuagauccaaaguaaacgggcaaaguggaaggauggaguucuucuggacaauuuuaaaaccuaaugaugcaaucaacuucgagaguaauggaaauuucauugcuccagaauaugcauacaaaauugucaagaaaggggacucagcaauuaugaaaagugaauuggaauaugguaacugcaacaccaagugucaaacuccaaugggggcgauaaacucuaguaugccauuccacaacauacacccucucaccaucggggaaugccccaaauaugugaaaucaaacagauuaguccuugcaacagggcucagaaauagcccucaaagagagagcagaagaaaaaagagaggacuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaagucaacucaaucauugacaaaaugaacacucaguuugaggccguuggaagggaauuuaauaacuuagaaaggagaauagagaauuuaaacaagaagauggaagacggguuucuagaugucuggacuuauaaugccgaacuucugguucucauggaaaaugagagaacucuagacuuucaugacucaaauguuaagaaccucuacgacaagguccgacuacagcuuagggauaaugcaaaggagcuggguaacgguuguuucgaguucuaucacaaaugugauaaugaauguauggaaaguauaagaaacggaacguacaacuauccgcaguauucagaagaagcaagauuaaaaagagaggaaauaagugggguaaaauuggaaucaauaggaacuuaccaaauacugucaauuuauucaacaguggcgaguucccuagcacuggcaaucaugauggcuggucuaucuuuauggaugugcuccaauggaucguuacaaugcagaauuugcauuuaa

SEQ ID NO: 39676 - RNA, 1701 nt, Artificial Sequence
  hemagglutinin__InfluenzaA__AFM78646
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaggucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39677 - RNA, 1698 nt, Artificial Sequence
  hemagglutinin__InfluenzaA__AFM85179
augaaaguaaaacuacugauccuguuauguacauuuacagcuacauaugcugacacaauauguauaggcuaccaugccaacaacucaaccgacacuguugacacaguacuugagaagaaugugacagugacacacucugucaaccuacuugagaacagucacaauggaaaacuaugucuacuaaaaggaauagccccccuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccaaacauaggggaccaaaggacccucuauuauacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaucucaaaugcaccaauggaugaaugugacgcgaagugucaaacaccucagggagcuauaaacagcagucuuccuuuccagaauguacacccagucacaauaggagaguguccaaaguaugucaggagugcaaaauuaaggaugguuacaggacuaaggaacaucccguccauucaauccagagguuuguuuggagccauugccgguuucauugaagggggguggacuggaaugguagaugggugguaugguuaucaucaucaaaaugagcaaggaucuggcuaugcugcagaucaaaaaagcacacaaaacgccauuaacgggauuacaaacaaggugaauucuguaauugagaaaaugaacacucaauucacagcugugggcaaagaauucaacaaauuugaaagaaggauggaaaacuuaaauaaaaagguugaugauggauuucuagacauuuggacauauaaugcagaauuguugguucuacuggaaaaugaaaggacuuuggauuuccacgacuccaaugugaagaaucuguaugagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 39678 - RNA, 1701 nt, Artificial Sequence
  hemagglutinin__InfluenzaA__AFN11846
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggagucgcucaggaugggaaaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuguauguucaagcaucagggagagucacagucucuaccaaaagaagccaacaaacuguaaucccgaauaucgggucuagacccugggugagggguaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauuggcaacugcaauucugaaugcaucacuccaaauggaagcauucccaaugacaaaccuuuucaaaauguaaacaggaucacguauggggccugucccagauauguuaagcaaaacacucugaaauuggcaacagggaugcggaauguaccagagaaacaaacuagaggcauauucggcgcaaucgcagguuucauagaaaaugguugggagggaaugguagacggcugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggaaaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuggguuucaucaugugggccugccaaaaaggcaacauuaggugcaacauuugcauuuga

SEQ ID NO: 39679 - RNA, 1701 nt, Artificial Sequence; identical to SEQ ID NO: 34034
  hemagglutinin__InfluenzaA__AFN17371

SEQ ID NO: 39680 - RNA, 1701 nt, Artificial Sequence; identical to SEQ ID NO: 33173
  hemagglutinin__InfluenzaA__AFN17381

SEQ ID NO: 39681 - RNA, 1701 nt, Artificial Sequence; identical to SEQ ID NO: 33173
  hemagglutinin__InfluenzaA__AFN17391

SEQ ID NO: 39682 - RNA, 1701 nt, Artificial Sequence
  hemagglutinin__InfluenzaA__AFN17401
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccuuccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39683 - RNA, 1701 nt, Artificial Sequence; identical to SEQ ID NO: 33173
  hemagglutinin__InfluenzaA__AFN17411

SEQ ID NO: 39684 - RNA, 1701 nt, Artificial Sequence; identical to SEQ ID NO: 33173
  hemagglutinin__InfluenzaA__AFN17421

SEQ ID NO: 39685 - RNA, 1701 nt, Artificial Sequence
  hemagglutinin__InfluenzaA__AFN17431
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccacaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuaccagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucugucauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39686 - RNA, 1701 nt, Artificial Sequence
  hemagglutinin__InfluenzaA__AFN17441
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccaaagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39687 - RNA, 1701 nt, Artificial Sequence; identical to SEQ ID NO: 38939
  hemagglutinin__InfluenzaA__AFN17451

SEQ ID NO: 39688 - RNA, 1701 nt, Artificial Sequence; identical to SEQ ID NO: 34015
  hemagglutinin__InfluenzaA__AFN17467

SEQ ID NO: 39689 - RNA, 1701 nt, Artificial Sequence; identical to SEQ ID NO: 36610
  hemagglutinin__InfluenzaA__AFN17477

SEQ ID NO: 39690 - RNA, 1701 nt, Artificial Sequence
  hemagglutinin__InfluenzaA__AFN17487
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccaccggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 39691 - RNA, 1701 nt, Artificial Sequence
  hemagglutinin__InfluenzaA__AFN17497
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuuuauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacgguugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39692 - RNA, 1701 nt, Artificial Sequence; identical to SEQ ID NO: 33173
  hemagglutinin__InfluenzaA__AFN17507

SEQ ID NO: 39693 - RNA, 1701 nt, Artificial Sequence; identical to SEQ ID NO: 34015
  hemagglutinin__InfluenzaA__AFN17517

SEQ ID NO: 39694 - RNA, 1701 nt, Artificial Sequence; identical to SEQ ID NO: 34034
  hemagglutinin__InfluenzaA__AFN17527

SEQ ID NO: 39695 - RNA, 1701 nt, Artificial Sequence; identical to SEQ ID NO: 33173
  hemagglutinin__InfluenzaA__AFN17537

SEQ ID NO: 39696 - RNA, 1701 nt, Artificial Sequence; identical to SEQ ID NO: 35277
  hemagglutinin__InfluenzaA__AFN17547

SEQ ID NO: 39697 - RNA, 1701 nt, Artificial Sequence; identical to SEQ ID NO: 34704
  hemagglutinin__InfluenzaA__AFN17557

SEQ ID NO: 39698 - RNA, 1701 nt, Artificial Sequence; identical to SEQ ID NO: 34015
  hemagglutinin__InfluenzaA__AFN17567

SEQ ID NO: 39699 - RNA, 1701 nt, Artificial Sequence; identical to SEQ ID NO: 35277
  hemagglutinin__InfluenzaA__AFN17574

SEQ ID NO: 39700 - RNA, 1701 nt, Artificial Sequence
  hemagglutinin__InfluenzaA__AFN17580
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggagccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39701 - RNA, 1701 nt, Artificial Sequence; identical to SEQ ID NO: 33173
  hemagglutinin__InfluenzaA__AFN17586

SEQ ID NO: 39702 - RNA, 1701 nt, Artificial Sequence; identical to SEQ ID NO: 34034
  hemagglutinin__InfluenzaA__AFN17595

SEQ ID NO: 39703 - RNA, 1701 nt, Artificial Sequence; identical to SEQ ID NO: 33173
  hemagglutinin__InfluenzaA__AFN17605

SEQ ID NO: 39704 - RNA, 1701 nt, Artificial Sequence; identical to SEQ ID NO: 33173
  hemagglutinin__InfluenzaA__AFN17615

SEQ ID NO: 39705 - RNA, 1701 nt, Artificial Sequence; identical to SEQ ID NO: 33173
  hemagglutinin__InfluenzaA__AFN17625

SEQ ID NO: 39706 - RNA, 1701 nt, Artificial Sequence; identical to SEQ ID NO: 33173
  hemagglutinin__InfluenzaA__AFN17635

SEQ ID NO: 39707 - RNA, 1701 nt, Artificial Sequence
  hemagglutinin__InfluenzaA__AFN17645
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaaggguugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39708 - RNA, 1701 nt, Artificial Sequence; identical to SEQ ID NO: 34034
  hemagglutinin__InfluenzaA__AFN17655

SEQ ID NO: 39709 - RNA, 1701 nt, Artificial Sequence; identical to SEQ ID NO: 34034
  hemagglutinin__InfluenzaA__AFN17665

SEQ ID NO: 39710 - RNA, 1701 nt, Artificial Sequence
  hemagglutinin__InfluenzaA__AFN17675
augaaggcaauacuaauaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcgaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuuuauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39711 - RNA, 1701 nt, Artificial Sequence
  hemagglutinin__InfluenzaA__AFN17685
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgagagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39712 - RNA, 1701 nt, Artificial Sequence; identical to SEQ ID NO: 33173
  hemagglutinin__InfluenzaA__AFN17695

SEQ ID NO: 39713 - RNA, 1701 nt, Artificial Sequence
  hemagglutinin__InfluenzaA__AFN17705
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggggguuggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39714 - RNA, 1701 nt, Artificial Sequence
  hemagglutinin__InfluenzaA__AFN17715
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaauucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggguucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39715 - RNA, 1701 nt, Artificial Sequence
  hemagglutinin__InfluenzaA__AFN17725
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagaccccaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39716 - RNA, 1701 nt, Artificial Sequence; identical to SEQ ID NO: 33803
  hemagglutinin__InfluenzaA__AFN17735

SEQ ID NO: 39717 - RNA, 1701 nt, Artificial Sequence; identical to SEQ ID NO: 33173
  hemagglutinin__InfluenzaA__AFN17742

SEQ ID NO: 39718 - RNA, 1701 nt, Artificial Sequence; identical to SEQ ID NO: 36733
  hemagglutinin__InfluenzaA__AFN17748

SEQ ID NO: 39719 - RNA, 1701 nt, Artificial Sequence; identical to SEQ ID NO: 34001
  hemagglutinin__InfluenzaA__AFN17757

SEQ ID NO: 39720 - RNA, 1701 nt, Artificial Sequence; identical to SEQ ID NO: 39714
  hemagglutinin__InfluenzaA__AFN17767

SEQ ID NO: 39721 - RNA, 1701 nt, Artificial Sequence; identical to SEQ ID NO: 38183
  hemagglutinin__InfluenzaA__AFN17774

SEQ ID NO: 39722 - RNA, 1701 nt, Artificial Sequence; identical to SEQ ID NO: 33173
  hemagglutinin__InfluenzaA__AFN17783

SEQ ID NO: 39723 - RNA, 1701 nt, Artificial Sequence; identical to SEQ ID NO: 39714
  hemagglutinin__InfluenzaA__AFN17793

SEQ ID NO: 39724 - RNA, 1701 nt, Artificial Sequence
  hemagglutinin__InfluenzaA__AFN17803
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugaguucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39725 - RNA, 1701 nt, Artificial Sequence
  hemagglutinin__InfluenzaA__AFN17813
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugacaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39726 - RNA, 1701 nt, Artificial Sequence
  hemagglutinin__InfluenzaA__AFN17823
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacgugcuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcgaauccuacauuaaugauaaagggaaagaaguccucgugcuaugggguauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39727 - RNA, 1701 nt, Artificial Sequence
  hemagglutinin__InfluenzaA__AFN17833
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccuaaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39728 - RNA, 1701 nt, Artificial Sequence
  hemagglutinin__InfluenzaA__AFN17843
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuguaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39729 - RNA, 1701 nt, Artificial Sequence; identical to SEQ ID NO: 33173
  hemagglutinin__InfluenzaA__AFN17853

SEQ ID NO: 39730 - RNA, 1701 nt, Artificial Sequence
  hemagglutinin__InfluenzaA__AFN17863
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugccggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39731 - RNA, 1701 nt, Artificial Sequence
  hemagglutinin__InfluenzaA__AFN17873
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaggcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacuugaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39732 - RNA, 1701 nt, Artificial Sequence
  hemagglutinin__InfluenzaA__AFN17883
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacucaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39733 - RNA, 1701 nt, Artificial Sequence; identical to SEQ ID NO: 33173
  hemagglutinin__InfluenzaA__AFN17893

SEQ ID NO: 39734 - RNA, 1701 nt, Artificial Sequence
  hemagglutinin__InfluenzaA__AFN17903
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugaaucgaacaaagguguaacggcagcauguccucaugcuggagcaaaaagcuucuacaaaaauuuaauauggcuaguuaaaaaaggaaauucauacccaaagcucagcaaauccuacguuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39735 - RNA, 1701 nt, Artificial Sequence
  hemagglutinin__InfluenzaA__AFN17919
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggagcaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39736 - RNA, 1701 nt, Artificial Sequence; identical to SEQ ID NO: 39730
  hemagglutinin__InfluenzaA__AFN17929

SEQ ID NO: 39737 - RNA, 1701 nt, Artificial Sequence; identical to SEQ ID NO: 39431
  hemagglutinin__InfluenzaA__AFN17939

SEQ ID NO: 39738 - RNA, 1701 nt, Artificial Sequence
  hemagglutinin__InfluenzaA__AFN17949
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuuuuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39739 - RNA, 1701 nt, Artificial Sequence
  hemagglutinin__InfluenzaA__AFN17959
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacguuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacaggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39740 - RNA, 1701 nt, Artificial Sequence
  hemagglutinin__InfluenzaA__AFN17969
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagaauggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaguuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39741 - RNA, 1701 nt, Artificial Sequence
  hemagglutinin__InfluenzaA__AFN17979
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39742 - RNA, 1701 nt, Artificial Sequence
  hemagglutinin__InfluenzaA__AFN17989
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauuggaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39743 - RNA, 1701 nt, Artificial Sequence; identical to SEQ ID NO: 33173
  hemagglutinin__InfluenzaA__AFN17999

SEQ ID NO: 39744 - RNA, 1701 nt, Artificial Sequence
  hemagglutinin__InfluenzaA__AFN18019
augaaggcaauacuaguaguucugcuauauacauuugcaaccgcaaaagcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39745 - RNA, 1701 nt, Artificial Sequence; identical to SEQ ID NO: 34034
  hemagglutinin__InfluenzaA__AFN18039

SEQ ID NO: 39746 - RNA, 1701 nt, Artificial Sequence; identical to SEQ ID NO: 33173
  hemagglutinin__InfluenzaA__AFN18049

SEQ ID NO: 39747 - RNA, 1701 nt, Artificial Sequence
  hemagglutinin__InfluenzaA__AFN18059
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcguauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacgcgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacuguugccaguucauugguacugguagucucccugggggcaaucaguuucuggaugugcucuaaugggucucuacaguguagaauauguauuuaa

SEQ ID NO: 39748 - RNA, 1701 nt, Artificial Sequence; identical to SEQ ID NO: 33472
  hemagglutinin__InfluenzaA__AFN18078

SEQ ID NO: 39749 - RNA, 1701 nt, Artificial Sequence
  hemagglutinin__InfluenzaA__AFN18088
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauaugcauuuaa

SEQ ID NO: 39750 - RNA, 1701 nt, Artificial Sequence
  hemagglutinin__InfluenzaA__AFN18098
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaguggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39751 - RNA, 1701 nt, Artificial Sequence
  hemagglutinin__InfluenzaA__AFN18105
augaaggcaauacuaauaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaaauugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuuuauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39752 - RNA, 1701 nt, Artificial Sequence; identical to SEQ ID NO: 39730
  hemagglutinin__InfluenzaA__AFN18107

SEQ ID NO: 39753 - RNA, 1701 nt, Artificial Sequence
  hemagglutinin__InfluenzaA__AFN18117
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacgcgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39754 - RNA, 1701 nt, Artificial Sequence
  hemagglutinin__InfluenzaA__AFN18119
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaauucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39755 - RNA, 1701 nt, Artificial Sequence
  hemagglutinin__InfluenzaA__AFN18121
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaagaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39756 - RNA, 1701 nt, Artificial Sequence; identical to SEQ ID NO: 39753
  hemagglutinin__InfluenzaA__AFN18133

SEQ ID NO: 39757 - RNA, 1701 nt, Artificial Sequence
  hemagglutinin__InfluenzaA__AFN18135
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaggguucuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39758 - RNA, 1701 nt, Artificial Sequence; identical to SEQ ID NO: 34015
  hemagglutinin__InfluenzaA__AFN18137

SEQ ID NO: 39759 - RNA, 1701 nt, Artificial Sequence
  hemagglutinin__InfluenzaA__AFN18139
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugccggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaggucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaucugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39760 - RNA, 1701 nt, Artificial Sequence; identical to SEQ ID NO: 39755
  hemagglutinin__InfluenzaA__AFN18141

SEQ ID NO: 39761 - RNA, 1701 nt, Artificial Sequence; identical to SEQ ID NO: 34034
  hemagglutinin__InfluenzaA__AFN18148

SEQ ID NO: 39762 - RNA, 1701 nt, Artificial Sequence; identical to SEQ ID NO: 34337
  hemagglutinin__InfluenzaA__AFN18155

SEQ ID NO: 39763 - RNA, 1701 nt, Artificial Sequence
  hemagglutinin__InfluenzaA__AFN18157
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39764 - RNA, 1701 nt, Artificial Sequence
  hemagglutinin__InfluenzaA__AFN18159
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugccggaucaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39765 - RNA, 1701 nt, Artificial Sequence
  hemagglutinin__InfluenzaA__AFN18164
augaaggcaauacuaguaguucugcuauauacauuugcaaccacaaaugcagacacauuauguauagguuaucaugcgaacaauucaacagacacuguagacacagugcuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaauaguaccgagauaugcauucgcaauggaaagaaaugcuggaucugguauuaucauuucaaauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagagcucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcggucuauucaacugucgccaguucauugguacugguagucucccugggggcaaucaguuucuggaugugcucuaaugggucucuacaguguagaauauguauuuaa

SEQ ID NO: 39766 - RNA, 1701 nt, Artificial Sequence
  hemagglutinin__InfluenzaA__AFN18171
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauagcgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaaaguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagucaaagauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39767 - RNA, 1701 nt, Artificial Sequence
  hemagglutinin__InfluenzaA__AFN18176
augaaggcaauacuaguaguucugcuauauacauuugcaaccgcaaaugcagacacauuauguauagguuaucaugcgaacaauucaacagacacuguagacacaguacuggaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39768 - RNA, 1701 nt, Artificial Sequence
  hemagglutinin__InfluenzaA__AFN18183
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcaucuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaaugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaauggaacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39769 - RNA, 1701 nt, Artificial Sequence; identical to SEQ ID NO: 35516
  hemagglutinin__InfluenzaA__AFN18195

SEQ ID NO: 39770 - RNA, 1701 nt, Artificial Sequence
  hemagglutinin__InfluenzaA__AFN18200
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39771 - RNA, 1701 nt, Artificial Sequence
  hemagglutinin__InfluenzaA__AFN18207
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaguuuaauauggcuaguuaaaaaaggaaauucauacccaaagcucagcaaauccuacauuaaugauaaagggagagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 39772 - RNA, 1701 nt, Artificial Sequence
  hemagglutinin__InfluenzaA__AFN18214
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaagucgaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 39773 - RNA, 1701 nt, Artificial Sequence
  hemagglutinin__InfluenzaA__AFN18224
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccacuuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39774 - RNA, 1701 nt, Artificial Sequence; identical to SEQ ID NO: 35516
  hemagglutinin__InfluenzaA__AFN18231

SEQ ID NO: 39775 - RNA, 1701 nt, Artificial Sequence
  hemagglutinin__InfluenzaA__AFN18233
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacgugcuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaggaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39776 - RNA, 1701 nt, Artificial Sequence
  hemagglutinin__InfluenzaA__AFN18243
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguaugguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39777 - RNA, 1701 nt, Artificial Sequence
  hemagglutinin__InfluenzaA__AFN18245
augaaggcaauacuaguaguucugcuauauauauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguucugguagucucccugggggcaaucaguuucuggaugugcucuaaugggucucuacaguguagaauauguauuuaa

SEQ ID NO: 39778 - RNA, 1701 nt, Artificial Sequence; identical to SEQ ID NO: 39773
  hemagglutinin__InfluenzaA__AFN18255

SEQ ID NO: 39779 - RNA, 1701 nt, Artificial Sequence; identical to SEQ ID NO: 39776
  hemagglutinin__InfluenzaA__AFN18260

SEQ ID NO: 39780 - RNA, 1701 nt, Artificial Sequence; identical to SEQ ID NO: 39776
  hemagglutinin__InfluenzaA__AFN18267

SEQ ID NO: 39781 - RNA, 1701 nt, Artificial Sequence
  hemagglutinin__InfluenzaA__AFN18269
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaaaguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39782 - RNA, 1701 nt, Artificial Sequence; identical to SEQ ID NO: 35514
  hemagglutinin__InfluenzaA__AFN18271

SEQ ID NO: 39783 - RNA, 1701 nt, Artificial Sequence; identical to SEQ ID NO: 35516
  hemagglutinin__InfluenzaA__AFN18273

SEQ ID NO: 39784 - RNA, 1701 nt, Artificial Sequence
  hemagglutinin__InfluenzaA__AFN18280
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaaucauacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39785 - RNA, 1701 nt, Artificial Sequence
  hemagglutinin__InfluenzaA__AFN18303
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaucaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39786 - RNA, 1701 nt, Artificial Sequence
  hemagglutinin__InfluenzaA__AFN18305
augaaggcaauacuaguaguucugcuauacacauuugcaaccgcaaaugcagacacauuauguauagguuaucaugcgaacaauucaacagacacuguagacacaguacuagaaaagaauguaacaguaacacacucugcuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaaucauacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccugggaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39787 - RNA, 1701 nt, Artificial Sequence
  hemagglutinin__InfluenzaA__AFN18307
augaaggcaauacuaguaguucugcuauauacauuugcagccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaauacuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39788 - RNA, 1701 nt, Artificial Sequence
  hemagglutinin__InfluenzaA__AFN18312
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguauaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguaaucucccugggggcaaucaguuucuggaugugcucuaaugggucucuacaguguagaauauguauuuaa

SEQ ID NO: 39789 - RNA, 1701 nt, Artificial Sequence
  hemagglutinin__InfluenzaA__AFN18319
augaaggcaauacuaguaguucugcuauacacauuugcaaccgcaaaugcagacacauuauguauagguuaucaugcgaacaauucaacagacacuguagacacaguacuagaaaagaauguaacaguaacacacucugcuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaaucauacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39790 - RNA, 1701 nt, Artificial Sequence
  hemagglutinin__InfluenzaA__AFN18324
augaaggcaauacuaguaguucugcuauauacauuugcaaccgcaaaugcagacacauuauguauagguuaucaugcgaacaauucaacagacacuguagacacaguacuagaaaagaauguaacagugacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccgaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39791 - RNA, 1701 nt, Artificial Sequence
  hemagglutinin__InfluenzaA__AFN18334
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucugaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39792 - RNA, 1701 nt, Artificial Sequence; identical to SEQ ID NO: 35289
  hemagglutinin__InfluenzaA__AFN18344

SEQ ID NO: 39793 - RNA, 1701 nt, Artificial Sequence; identical to SEQ ID NO: 33173
  hemagglutinin__InfluenzaA__AFN18354

SEQ ID NO: 39794 - RNA, 1701 nt, Artificial Sequence
  hemagglutinin__InfluenzaA__AFN18364
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacuugaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaagauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39795 - RNA, 1701 nt, Artificial Sequence; identical to SEQ ID NO: 33173
  hemagglutinin__InfluenzaA__AFN18374

SEQ ID NO: 39796 - RNA, 1701 nt, Artificial Sequence
  hemagglutinin__InfluenzaA__AFN18381
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguaaagccgggagacaaaauaacauucgaagcaacuggaaaucuagugguaccgagauaugcauucgcaauggaaagaaaugcuggaucugguauuaucauuucagauacaccaguccaagauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39797 - RNA, 1701 nt, Artificial Sequence
  hemagglutinin__InfluenzaA__AFN18390
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagauaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39798 - RNA, 1701 nt, Artificial Sequence
  hemagglutinin__InfluenzaA__AFN18400
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguaaccccauugcauuuggguaaauguaacauugcuggcuggauccugggaaauccagagugugaaucacucuccaaagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaauguuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39799 - RNA, 1701 nt, Artificial Sequence
  hemagglutinin__InfluenzaA__AFN18410
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguaguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaauucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaucacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauaugcauuuaa

SEQ ID NO: 39800 - RNA, 1701 nt, Artificial Sequence; identical to SEQ ID NO: 33173
  hemagglutinin__InfluenzaA__AFN18420

SEQ ID NO: 39801 - RNA, 1701 nt, Artificial Sequence
  hemagglutinin__InfluenzaA__AFN18430
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaaaacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaaggaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39802 - RNA, 1701 nt, Artificial Sequence; identical to SEQ ID NO: 33173
  hemagglutinin__InfluenzaA__AFN18440

SEQ ID NO: 39803 - RNA, 1701 nt, Artificial Sequence; identical to SEQ ID NO: 33173
  hemagglutinin__InfluenzaA__AFN18450

SEQ ID NO: 39804 - RNA, 1701 nt, Artificial Sequence
  hemagglutinin__InfluenzaA__AFN18460
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcugaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39805 - RNA, 1701 nt, Artificial Sequence; identical to SEQ ID NO: 34034
  hemagglutinin__InfluenzaA__AFN18470

SEQ ID NO: 39806 - RNA, 1701 nt, Artificial Sequence; identical to SEQ ID NO: 33264
  hemagglutinin__InfluenzaA__AFN18480

SEQ ID NO: 39807 - RNA, 1701 nt, Artificial Sequence; identical to SEQ ID NO: 34034
  hemagglutinin__InfluenzaA__AFN18490

SEQ ID NO: 39808 - RNA, 1701 nt, Artificial Sequence; identical to SEQ ID NO: 33206
  hemagglutinin__InfluenzaA__AFN18497

SEQ ID NO: 39809 - RNA, 1701 nt, Artificial Sequence
  hemagglutinin__InfluenzaA__AFN18512
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39810 - RNA, 1701 nt, Artificial Sequence
  hemagglutinin__InfluenzaA__AFN18519
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagaaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39811 - RNA, 1701 nt, Artificial Sequence
  hemagglutinin__InfluenzaA__AFN18521
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucaggggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39812 - RNA, 1701 nt, Artificial Sequence; identical to SEQ ID NO: 38366
  hemagglutinin__InfluenzaA__AFN18528

SEQ ID NO: 39813 - RNA, 1701 nt, Artificial Sequence; identical to SEQ ID NO: 34625
  hemagglutinin__InfluenzaA__AFN18531

SEQ ID NO: 39814 - RNA, 1701 nt, Artificial Sequence
  hemagglutinin__InfluenzaA__AFN18543
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39815 - RNA, 1701 nt, Artificial Sequence
  hemagglutinin__InfluenzaA__AFN18545
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugauaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39816 - RNA, 1701 nt, Artificial Sequence; identical to SEQ ID NO: 34034
  hemagglutinin__InfluenzaA__AFN18550

SEQ ID NO: 39817 - RNA, 1701 nt, Artificial Sequence
  hemagglutinin__InfluenzaA__AFN18557
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39818 - RNA, 1701 nt, Artificial Sequence
  hemagglutinin__InfluenzaA__AFN18559
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaaaucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39819 - RNA, 1701 nt, Artificial Sequence
  hemagglutinin__InfluenzaA__AFN18561
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaaaccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39820 - RNA, 1701 nt, Artificial Sequence
  hemagglutinin__InfluenzaA__AFN18563
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucguguuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39821 - RNA, 1701 nt, Artificial Sequence
  hemagglutinin__InfluenzaA__AFN18565
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauggagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39822 - RNA, 1701 nt, Artificial Sequence
  hemagglutinin__InfluenzaA__AFN18570
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacaguaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39823 - RNA, 1701 nt, Artificial Sequence; identical to SEQ ID NO: 33173
  hemagglutinin__InfluenzaA__AFN18580

SEQ ID NO: 39824 - RNA, 1701 nt, Artificial Sequence
  hemagglutinin__InfluenzaA__AFN18590
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugagaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39825 - RNA, 1701 nt, Artificial Sequence
  hemagglutinin__InfluenzaA__AFN18600
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaaaucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacgcgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39826 - RNA, 1701 nt, Artificial Sequence
  hemagglutinin__InfluenzaA__AFN18610
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauaugcauuuaa

SEQ ID NO: 39827 - RNA, 1701 nt, Artificial Sequence
  hemagglutinin__InfluenzaA__AFN18617
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagagugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaaaagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39828 - RNA, 1701 nt, Artificial Sequence; identical to SEQ ID NO: 34034
  hemagglutinin__InfluenzaA__AFN18622

SEQ ID NO: 39829 - RNA, 1701 nt, Artificial Sequence; identical to SEQ ID NO: 33803
  hemagglutinin__InfluenzaA__AFN18629

SEQ ID NO: 39830 - RNA, 1701 nt, Artificial Sequence; identical to SEQ ID NO: 39730
  hemagglutinin__InfluenzaA__AFN18634

SEQ ID NO: 39831 - RNA, 1701 nt, Artificial Sequence
  hemagglutinin__InfluenzaA__AFN18644
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagagugccauugacgagauuacuaacaaaguaaauucuguuauugaaaaggugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39832 - RNA, 1701 nt, Artificial Sequence
  hemagglutinin__InfluenzaA__AFN18654
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucuggcauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgacuugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39833 - RNA, 1701 nt, Artificial Sequence
  hemagglutinin__InfluenzaA__AFN18664
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuugauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcgauaaacaccagccuaccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39834 - RNA, 1701 nt, Artificial Sequence; identical to SEQ ID NO: 39730
  hemagglutinin__InfluenzaA__AFN18674

SEQ ID NO: 39835 - RNA, 1701 nt, Artificial Sequence; identical to SEQ ID NO: 33173
  hemagglutinin__InfluenzaA__AFN18684

SEQ ID NO: 39836 - RNA, 1701 nt, Artificial Sequence
  hemagglutinin__InfluenzaA__AFN18694
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacggaaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39837 - RNA, 1701 nt, Artificial Sequence
  hemagglutinin__InfluenzaA__AFN18704
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagagugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39838 - RNA, 1701 nt, Artificial Sequence
  hemagglutinin__InfluenzaA__AFN18714
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39839 - RNA, 1701 nt, Artificial Sequence; identical to SEQ ID NO: 33173
  hemagglutinin__InfluenzaA__AFN18721

SEQ ID NO: 39840 - RNA, 1701 nt, Artificial Sequence; identical to SEQ ID NO: 35839
  hemagglutinin__InfluenzaA__AFN18725

SEQ ID NO: 39841 - RNA, 1701 nt, Artificial Sequence
  hemagglutinin__InfluenzaA__AFN18735
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaacuuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39842 - RNA, 1701 nt, Artificial Sequence; identical to SEQ ID NO: 33472
  hemagglutinin__InfluenzaA__AFN18742

SEQ ID NO: 39843 - RNA, 1701 nt, Artificial Sequence; identical to SEQ ID NO: 34679
  hemagglutinin__InfluenzaA__AFN18747

SEQ ID NO: 39844 - RNA, 1701 nt, Artificial Sequence
  hemagglutinin__InfluenzaA__AFN18757
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagcgguaccgagauaugcauucgcaauggaaagaaaugcuggaucuggcauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39845 - RNA, 1701 nt, Artificial Sequence; identical to SEQ ID NO: 33173
  hemagglutinin__InfluenzaA__AFN18767

SEQ ID NO: 39846 - RNA, 1701 nt, Artificial Sequence
  hemagglutinin__InfluenzaA__AFN18774
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagagugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39847 - RNA, 1701 nt, Artificial Sequence
  hemagglutinin__InfluenzaA__AFN18776
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaucacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaacuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39848 - RNA, 1701 nt, Artificial Sequence; identical to SEQ ID NO: 34039
  hemagglutinin__InfluenzaA__AFN18778

SEQ ID NO: 39849 - RNA, 1701 nt, Artificial Sequence
  hemagglutinin__InfluenzaA__AFN18784
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaaaaugaauacacaguucacagcgguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 39850 - RNA, 1701 nt, Artificial Sequence; identical to SEQ ID NO: 34039
  hemagglutinin__InfluenzaA__AFN18789

SEQ ID NO: 39851 - RNA, 1701 nt, Artificial Sequence; identical to SEQ ID NO: 33173
  hemagglutinin__InfluenzaA__AFN18799

SEQ ID NO: 39852 - RNA, 1701 nt, Artificial Sequence; identical to SEQ ID NO: 33173
  hemagglutinin__InfluenzaA__AFN18809

SEQ ID NO: 39853 - RNA, 1701 nt, Artificial Sequence; identical to SEQ ID NO: 34679
  hemagglutinin__InfluenzaA__AFN18816

SEQ ID NO: 39854 - RNA, 1701 nt, Artificial Sequence; identical to SEQ ID NO: 33173
  hemagglutinin__InfluenzaA__AFN18818

SEQ ID NO: 39855 - RNA, 1701 nt, Artificial Sequence
  hemagglutinin__InfluenzaA__AFN18820
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaacuguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39856 - RNA, 1701 nt, Artificial Sequence; identical to SEQ ID NO: 33173
  hemagglutinin__InfluenzaA__AFN18822

SEQ ID NO: 39857 - RNA, 1701 nt, Artificial Sequence
  hemagglutinin__InfluenzaA__AFN18824
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaacuaaacagagaagaaauagaugggguaaggcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39858 - RNA, 1701 nt, Artificial Sequence
  hemagglutinin__InfluenzaA__AFN18826
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaaaguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39859 - RNA, 1701 nt, Artificial Sequence
  hemagglutinin__InfluenzaA__AFN18828
augaaggcaauacuaguaguucugcuauauacauuugcgaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucaaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacagcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgauuacaauuggaaaauguccaaaauauguaaaaagcauaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagaucacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39860 - RNA, 1701 nt, Artificial Sequence; identical to SEQ ID NO: 39844
  hemagglutinin__InfluenzaA__AFN18830

SEQ ID NO: 39861 - RNA, 1701 nt, Artificial Sequence; identical to SEQ ID NO: 33173
  hemagglutinin__InfluenzaA__AFN18832

SEQ ID NO: 39862 - RNA, 1701 nt, Artificial Sequence; identical to SEQ ID NO: 34039
  hemagglutinin__InfluenzaA__AFN18834

SEQ ID NO: 39863 - RNA, 1701 nt, Artificial Sequence
  hemagglutinin__InfluenzaA__AFN18849
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaauguagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39864 - RNA, 1701 nt, Artificial Sequence
  hemagglutinin__InfluenzaA__AFN18856
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaaaacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugcugaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39865 - RNA, 1701 nt, Artificial Sequence
  hemagglutinin__InfluenzaA__AFN18858
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauaugcauuuaa

SEQ ID NO: 39866 - RNA, 1701 nt, Artificial Sequence
  hemagglutinin__InfluenzaA__AFN18860
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaauggacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39867 - RNA, 1701 nt, Artificial Sequence
  hemagglutinin__InfluenzaA__AFN18865
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaucaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuauugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39868 - RNA, 1701 nt, Artificial Sequence
  hemagglutinin__InfluenzaA__AFN18875
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugccggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugcccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaauucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39869 - RNA, 1701 nt, Artificial Sequence
  hemagglutinin__InfluenzaA__AFN18885
augaaggcaauacuaauaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccaaccucccauuucagaauauacauccgaucacaauuggaaaauguccaaaauauguaaaaagcacaaaauugagacuggccacaggacugaggaaugucccgucuacucaaucuagaggccuauuuggggccauugccgguuuuauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguaaaauauguauuuaa

SEQ ID NO: 39870 - RNA, 1701 nt, Artificial Sequence; identical to SEQ ID NO: 33173
  hemagglutinin__InfluenzaA__AFN18892

SEQ ID NO: 39871 - RNA, 1701 nt, Artificial Sequence
  hemagglutinin__InfluenzaA__AFN18894
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacauccaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugccggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39872 - RNA, 1701 nt, Artificial Sequence; identical to SEQ ID NO: 39846
  hemagglutinin__InfluenzaA__AFN18903

SEQ ID NO: 39873 - RNA, 1701 nt, Artificial Sequence
  hemagglutinin__InfluenzaA__AFN18910
augaaggcaauacuaguaguucugcuauauacauuugcaaccgcaaaugcagacacauuauguauagguuaucaugcgaacaauucaacagacacuguagacacuguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39874 - RNA, 1701 nt, Artificial Sequence
  hemagglutinin__InfluenzaA__AFN18912
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacauccaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugccggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaucaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39875 - RNA, 1701 nt, Artificial Sequence
  hemagglutinin__InfluenzaA__AFN18917
augaaggcaauacuaguaguucugcuauauacauuugcaaccgcaaaugcagacacauuauguauagguuaucaugcgaacaauucaacagacacuguagacacuguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaaaccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39876 - RNA, 1701 nt, Artificial Sequence; identical to SEQ ID NO: 33173
  hemagglutinin__InfluenzaA__AFN18927

SEQ ID NO: 39877 - RNA, 1701 nt, Artificial Sequence
  hemagglutinin__InfluenzaA__AFN18937
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39878 - RNA, 1701 nt, Artificial Sequence
  hemagglutinin__InfluenzaA__AFN18952
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacaggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacguucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39879 - RNA, 1701 nt, Artificial Sequence
  hemagglutinin__InfluenzaA__AFN18957
augaaggcaauacuaguaguucugcuauauacauucgcaaccgcaaaugcagacacauuauguauagguuaucaugcgaacaauucaacagacacuguagacacaguacuagaaaagaauguaacaguaacacacucuguuaaccuucuagaagacaaucauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcuccgugucaucauuugaaagguuugaaauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugauggcuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39880 - RNA, 1701 nt, Artificial Sequence; identical to SEQ ID NO: 39777
  hemagglutinin__InfluenzaA__AFN18964

SEQ ID NO: 39881 - RNA, 1701 nt, Artificial Sequence
  hemagglutinin__InfluenzaA__AFN18974
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcugguuggauccugggaaauccagagugugaaucacucuccacagcaagcucaugguccuacauuguggaaacaucuaguucagacaauggaacguguuacccaggagauuucaucgauuaugaggagcuaagagagcaauugagcucaaugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaaaaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggauuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaugaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39882 - RNA, 1701 nt, Artificial Sequence
  hemagglutinin__InfluenzaA__AFN18979
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaacccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39883 - RNA, 1701 nt, Artificial Sequence
  hemagglutinin__InfluenzaA__AFN18982
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaauucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggguugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaucacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39884 - RNA, 1701 nt, Artificial Sequence; identical to SEQ ID NO: 39776
  hemagglutinin__InfluenzaA__AFN18984

SEQ ID NO: 39885 - RNA, 1701 nt, Artificial Sequence; identical to SEQ ID NO: 33173
  hemagglutinin__InfluenzaA__AFN18986

SEQ ID NO: 39886 - RNA, 1701 nt, Artificial Sequence
  hemagglutinin__InfluenzaA__AFN18988
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacuuuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugagagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucgcuacaguguagaauauguauuuaa

SEQ ID NO: 39887 - RNA, 1701 nt, Artificial Sequence
  hemagglutinin__InfluenzaA__AFN18993
augaaggcaauacuaguaguucugcuauauacauuugcaaccgcaaaugcagacacauuauguauagguuaucaugcgaacaauucaacagacacuguagacacaguacuagaaaagaauguaacagugacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccacaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuagaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccgaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39888 - RNA, 1701 nt, Artificial Sequence; identical to SEQ ID NO: 35535
  hemagglutinin__InfluenzaA__AFN18999

SEQ ID NO: 39889 - RNA, 1701 nt, Artificial Sequence
  hemagglutinin__InfluenzaA__AFN19006
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgacuugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39890 - RNA, 1701 nt, Artificial Sequence; identical to SEQ ID NO: 33173
  hemagglutinin__InfluenzaA__AFN19026

SEQ ID NO: 39891 - RNA, 1701 nt, Artificial Sequence; identical to SEQ ID NO: 34313
  hemagglutinin__InfluenzaA__AFN19036

SEQ ID NO: 39892 - RNA, 1701 nt, Artificial Sequence; identical to SEQ ID NO: 33173
  hemagglutinin__InfluenzaA__AFN19043

SEQ ID NO: 39893 - RNA, 1701 nt, Artificial Sequence; identical to SEQ ID NO: 33173
  hemagglutinin__InfluenzaA__AFN19053

SEQ ID NO: 39894 - RNA, 1701 nt, Artificial Sequence; identical to SEQ ID NO: 33173
  hemagglutinin__InfluenzaA__AFN19063

SEQ ID NO: 39895 - RNA, 1701 nt, Artificial Sequence
  hemagglutinin__InfluenzaA__AFN19070
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcugaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39896 - RNA, 1701 nt, Artificial Sequence
  hemagglutinin__InfluenzaA__AFN19076
augaaggcaauacuaguaguucugcuauauacauuugcaaccgcaaaugcagacacauuauguauagguuaucaugcgaacaauucaacagacacuguagacacaguacuagaaaaggauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39897 - RNA, 1701 nt, Artificial Sequence; identical to SEQ ID NO: 33173
  hemagglutinin__InfluenzaA__AFN19082

SEQ ID NO: 39898 - RNA, 1701 nt, Artificial Sequence; identical to SEQ ID NO: 33173
  hemagglutinin__InfluenzaA__AFN19088

SEQ ID NO: 39899 - RNA, 1701 nt, Artificial Sequence; identical to SEQ ID NO: 33173
  hemagglutinin__InfluenzaA__AFN19097

SEQ ID NO: 39900 - RNA, 1701 nt, Artificial Sequence; identical to SEQ ID NO: 33173
  hemagglutinin__InfluenzaA__AFN19104

SEQ ID NO: 39901 - RNA, 1701 nt, Artificial Sequence; identical to SEQ ID NO: 33173
  hemagglutinin__InfluenzaA__AFN19113

SEQ ID NO: 39902 - RNA, 1701 nt, Artificial Sequence; identical to SEQ ID NO: 33173
  hemagglutinin__InfluenzaA__AFN19119

SEQ ID NO: 39903 - RNA, 1701 nt, Artificial Sequence
  hemagglutinin__InfluenzaA__AFN19125
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 39904 - RNA, 1701 nt, Artificial Sequence; identical to SEQ ID NO: 34001
  hemagglutinin__InfluenzaA__AFN19134

SEQ ID NO: 39905 - RNA, 1701 nt, Artificial Sequence; identical to SEQ ID NO: 34001
  hemagglutinin__InfluenzaA__AFN19144

SEQ ID NO: 39906 - RNA, 1701 nt, Artificial Sequence; identical to SEQ ID NO: 38939
  hemagglutinin__InfluenzaA__AFN19154

SEQ ID NO: 39907 - RNA, 1701 nt, Artificial Sequence; identical to SEQ ID NO: 34001
  hemagglutinin__InfluenzaA__AFN19164

SEQ ID NO: 39908 - RNA, 1701 nt, Artificial Sequence; identical to SEQ ID NO: 33173
  hemagglutinin__InfluenzaA__AFN19174

SEQ ID NO: 39909 - RNA, 1701 nt, Artificial Sequence; identical to SEQ ID NO: 33173
  hemagglutinin__InfluenzaA__AFN19184

SEQ ID NO: 39910 - RNA, 1701 nt, Artificial Sequence; identical to SEQ ID NO: 33173
  hemagglutinin__InfluenzaA__AFN19194

SEQ ID NO: 39911 - RNA, 1701 nt, Artificial Sequence; identical to SEQ ID NO: 33173
  hemagglutinin__InfluenzaA__AFN19203

SEQ ID NO: 39912 - RNA, 1701 nt, Artificial Sequence; identical to SEQ ID NO: 33173
  hemagglutinin__InfluenzaA__AFN19213

SEQ ID NO: 39913 - RNA, 1701 nt, Artificial Sequence; identical to SEQ ID NO: 33173
  hemagglutinin__InfluenzaA__AFN19223

SEQ ID NO: 39914 - RNA, 1701 nt, Artificial Sequence; identical to SEQ ID NO: 33173
  hemagglutinin__InfluenzaA__AFN19233

SEQ ID NO: 39915 - RNA, 1701 nt, Artificial Sequence
  hemagglutinin__InfluenzaA__AFN19243
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaagauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39916 - RNA, 1701 nt, Artificial Sequence
  hemagglutinin__InfluenzaA__AFN19250
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagaaugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauguuccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39917 - RNA, 1701 nt, Artificial Sequence; identical to SEQ ID NO: 33801
  hemagglutinin__InfluenzaA__AFN19259

SEQ ID NO: 39918 - RNA, 1701 nt, Artificial Sequence; identical to SEQ ID NO: 33173
  hemagglutinin__InfluenzaA__AFN19269

SEQ ID NO: 39919 - RNA, 1701 nt, Artificial Sequence; identical to SEQ ID NO: 33173
  hemagglutinin__InfluenzaA__AFN19279

SEQ ID NO: 39920 - RNA, 1701 nt, Artificial Sequence; identical to SEQ ID NO: 34034
  hemagglutinin__InfluenzaA__AFN19286

SEQ ID NO: 39921 - RNA, 1701 nt, Artificial Sequence; identical to SEQ ID NO: 33173
  hemagglutinin__InfluenzaA__AFN19295

SEQ ID NO: 39922 - RNA, 1701 nt, Artificial Sequence; identical to SEQ ID NO: 33956
  hemagglutinin__InfluenzaA__AFN19305

SEQ ID NO: 39923 - RNA, 1701 nt, Artificial Sequence; identical to SEQ ID NO: 34039
  hemagglutinin__InfluenzaA__AFN19315

SEQ ID NO: 39924 - RNA, 1701 nt, Artificial Sequence; identical to SEQ ID NO: 33173
  hemagglutinin__InfluenzaA__AFN19325

SEQ ID NO: 39925 - RNA, 1701 nt, Artificial Sequence; identical to SEQ ID NO: 33173
  hemagglutinin__InfluenzaA__AFN19335

SEQ ID NO: 39926 - RNA, 1701 nt, Artificial Sequence
  hemagglutinin__InfluenzaA__AFN19344
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuguuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 39927 - RNA, 1701 nt, Artificial Sequence
  hemagglutinin__InfluenzaA__AFN19351
augaagacuaucauugcuuugagcuacauucuaugucugguuuucgcucaaaaacuuccuggaaaugacaacagcauggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacguuaggugcaacauuugcauuuga

SEQ ID NO: 39928 - RNA, 1701 nt, Artificial Sequence
  hemagglutinin__InfluenzaA__AFN19355
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39929 - RNA, 1701 nt, Artificial Sequence
  hemagglutinin__InfluenzaA__AFN19357
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcagcugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39930 - RNA, 1701 nt, Artificial Sequence
  hemagglutinin__InfluenzaA__AFN19361
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacaaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccagcauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39931 - RNA, 1701 nt, Artificial Sequence
  hemagglutinin__InfluenzaA__AFN19363
augaagacuaucauugcuuugagcuacauucuaugucugguuuucgcucaaaaacuuccuggaaaugacaacagcacggcaacgcugugccuugggcaccaugcaguaccaaacggaacgauagugaagacaaucacgaaugaccaaauugaaguuacuaaugccacugagcugguucagauuuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39932 - RNA, 1701 nt, Artificial Sequence
  hemagglutinin__InfluenzaA__AFN19365
augaagaccaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguagaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39933 - RNA, 1701 nt, Artificial Sequence
  hemagglutinin__InfluenzaA__AFN19367
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaguaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39934 - RNA, 1701 nt, Artificial Sequence
  hemagglutinin__InfluenzaA__AFN19369
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaguaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39935 - RNA, 1701 nt, Artificial Sequence
  hemagglutinin__InfluenzaA__AFN19373
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39936 - RNA, 1701 nt, Artificial Sequence
  hemagglutinin__InfluenzaA__AFN19375
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39937 - RNA, 1701 nt, Artificial Sequence
  hemagglutinin__InfluenzaA__AFN19377
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaguaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauaugucgaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaauggcaacauuaggugcaacauuugcauuuga

SEQ ID NO: 39938 - RNA, 1701 nt, Artificial Sequence
  hemagglutinin__InfluenzaA__AFN19379
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39939 - RNA, 1701 nt, Artificial Sequence; identical to SEQ ID NO: 39935
  hemagglutinin__InfluenzaA__AFN19381

SEQ ID NO: 39940 - RNA, 1701 nt, Artificial Sequence
  hemagglutinin__InfluenzaA__AFN19383
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaguaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccaggauaaggaauaucccuagcagaauaagcaucuauuggacaauaguaaaaccgggggacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaacgggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39941 - RNA, 1701 nt, Artificial Sequence
  hemagglutinin__InfluenzaA__AFN19385
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaguaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagauaucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39942 - RNA, 1701 nt, Artificial Sequence
  hemagglutinin__InfluenzaA__AFN19387
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaguaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauaugucgaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39943 - RNA, 1701 nt, Artificial Sequence
  hemagglutinin__InfluenzaA__AFN19389
augaagacuaucauugcuuugagcuacauucuaugucugguuuucgcucaaaaacuuccuggaaaugacaacagcacggcaacgcuaugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39944 - RNA, 1701 nt, Artificial Sequence; identical to SEQ ID NO: 39928
  hemagglutinin__InfluenzaA__AFN19391

SEQ ID NO: 39945 - RNA, 1701 nt, Artificial Sequence
  hemagglutinin__InfluenzaA__AFN19393
augaagaccaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaagcaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39946 - RNA, 1701 nt, Artificial Sequence
  hemagglutinin__InfluenzaA__AFN19397
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaguaaacugcacacuaauagaugcucuauugggagacccucagugugauggcuuccaaaauaagaagugggaccuuuuuguugaacgaagcaaagccuacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauaugucgaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39947 - RNA, 1701 nt, Artificial Sequence; identical to SEQ ID NO: 39928
  hemagglutinin__InfluenzaA__AFN19399

SEQ ID NO: 39948 - RNA, 1701 nt, Artificial Sequence; identical to SEQ ID NO: 39946
  hemagglutinin__InfluenzaA__AFN19401

SEQ ID NO: 39949 - RNA, 1701 nt, Artificial Sequence; identical to SEQ ID NO: 39928
  hemagglutinin__InfluenzaA__AFN19403

SEQ ID NO: 39950 - RNA, 1701 nt, Artificial Sequence
  hemagglutinin__InfluenzaA__AFN19405
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaguaaacugcacacuaauagaugcucuauugggagacccucagugugauggcuuccaaaauaagaagugggaccuuuuuguugaacgaagcaaagccuacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagagaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauaugucgaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39951 - RNA, 1701 nt, Artificial Sequence
  hemagglutinin__InfluenzaA__AFN19407
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggucuggagucacucaaaacggaacaaguucugcuugcaugaggagaucuaauaguaguuucuuuaguagauugaauugguugacccacuuaaacuucaaauacccagcauugaacgugacuaugccaaacaaugaacaguuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39952 - RNA, 1701 nt, Artificial Sequence
  hemagglutinin__InfluenzaA__AFN19409
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaauaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39953 - RNA, 1701 nt, Artificial Sequence; identical to SEQ ID NO: 39942
  hemagglutinin__InfluenzaA__AFN19411

SEQ ID NO: 39954 - RNA, 1701 nt, Artificial Sequence; identical to SEQ ID NO: 39928
  hemagglutinin__InfluenzaA__AFN19413

SEQ ID NO: 39955 - RNA, 1701 nt, Artificial Sequence
  hemagglutinin__InfluenzaA__AFN19415
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaguaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39956 - RNA, 1701 nt, Artificial Sequence
  hemagglutinin__InfluenzaA__AFN19417
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaauugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucuggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauaaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggacgguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggcuugccaaaagggcaacauuaggugcaacauuugcauuuga

SEQ ID NO: 39957 - RNA, 1701 nt, Artificial Sequence
  hemagglutinin__InfluenzaA__AFN19423
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaucacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39958 - RNA, 1701 nt, Artificial Sequence
  hemagglutinin__InfluenzaA__AFN19425
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaguaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaguacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauaugucgaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39959 - RNA, 1701 nt, Artificial Sequence
  hemagglutinin__InfluenzaA__AFN19437
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucagaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauaggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacuauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39960 - RNA, 1701 nt, Artificial Sequence
  hemagglutinin__InfluenzaA__AFN19439
augaagacuaucauugcuuugagccacauucuaugucugguuuucgcucaaaaacuuccugaaaaugacaacagcacggcaacgcugugucuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaauaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaccaucaggaagaaucacaguaucuacaaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39961 - RNA, 1701 nt, Artificial Sequence
  hemagglutinin__InfluenzaA__AFN19443
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauagcuucuuuaguagauuaaauugguugacucacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccaggauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaucaacauacaauugaccuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaucgguuccagaucaagggaguugagcugaagucaggguacaaagauuggauccuauggaucuccuuugccauaucauguuuuuugcuuuguguugcuuuguugggguucaucaugugggccugccaaaagggcaacauuaggugcaacauuugcauuuga

SEQ ID NO: 39962 - RNA, 1701 nt, Artificial Sequence
  hemagglutinin__InfluenzaA__AFN19445
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccuaaugacaaaccauuccaaaauguaaacaggaucacauacggggccugucccagauauguuaagcaaagcacucugagauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39963 - RNA, 1701 nt, Artificial Sequence
  hemagglutinin__InfluenzaA__AFN19447
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39964 - RNA, 1701 nt, Artificial Sequence
  hemagglutinin__InfluenzaA__AFN19451
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaauggaguugagcugaagucaggguacaaagauuggauccuauggauuucauuugccauaucauguuuuuugcuuuguguugcuuuguugggguucaucaugugggccugccaaaagggcaacauuaggugcaacauuugcauuuga

SEQ ID NO: 39965 - RNA, 1701 nt, Artificial Sequence
  hemagglutinin__InfluenzaA__AFN19453
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacggagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaagugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccaggucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39966 - RNA, 1701 nt, Artificial Sequence
  hemagglutinin__InfluenzaA__AFN19455
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuacgaugugccggauuaugccucccuuaggucacuaguugccucauccggaacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39967 - RNA, 1701 nt, Artificial Sequence
  hemagglutinin__InfluenzaA__AFN19457
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccacagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacggagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39968 - RNA, 1701 nt, Artificial Sequence
  hemagglutinin__InfluenzaA__AFN19459
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39969 - RNA, 1701 nt, Artificial Sequence
  hemagglutinin__InfluenzaA__AFN19461
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacagcccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauagcuucuuuaguagauuaaauugguugacccacuuaaacuucaaauacccagcauugaacgugacuaugccaaacaaugaacaauuugacaaauuguacauuugggggguccaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaggucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39970 - RNA, 1701 nt, Artificial Sequence
  hemagglutinin__InfluenzaA__AFN19465
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccgggcacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauauaggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguauugcuuuguugggguucaucaugugggccugccaaaagggcaacauuaggugcaacauuugcauuuga

SEQ ID NO: 39971 - RNA, 1701 nt, Artificial Sequence
  hemagglutinin__InfluenzaA__AFN19467
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacagaaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39972 - RNA, 1701 nt, Artificial Sequence; identical to SEQ ID NO: 39965
  hemagglutinin__InfluenzaA__AFN19469

SEQ ID NO: 39973 - RNA, 1701 nt, Artificial Sequence
  hemagglutinin__InfluenzaA__AFN19471
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcguugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39974 - RNA, 1701 nt, Artificial Sequence
  hemagglutinin__InfluenzaA__AFN19473
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcggcaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaaucguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugauaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39975 - RNA, 1701 nt, Artificial Sequence
  hemagglutinin__InfluenzaA__AFN19475
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaaacugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39976 - RNA, 1701 nt, Artificial Sequence
  hemagglutinin__InfluenzaA__AFN19477
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauacuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucaucaggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39977 - RNA, 1701 nt, Artificial Sequence
  hemagglutinin__InfluenzaA__AFN19479
augaagacuaucauugcuuugagcugcauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaaguacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuugugucgcuuuguugggguucaucaugugggccugccaaaagggcaacauuaggugcaacauuugcauuuga

SEQ ID NO: 39978 - RNA, 1701 nt, Artificial Sequence
  hemagglutinin__InfluenzaA__AFN19483
augaagacuaucauugcuuugagcuacauucuaugucugguuuucgcucaaaaacuuccuggaaaugacaauagcacagcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacagaaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39979 - RNA, 1701 nt, Artificial Sequence
  hemagglutinin__InfluenzaA__AFN19485
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcaccuauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39980 - RNA, 1701 nt, Artificial Sequence
  hemagglutinin__InfluenzaA__AFN19487
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39981 - RNA, 1701 nt, Artificial Sequence
  hemagglutinin__InfluenzaA__AFN19491
augaagacuaucauugcuuugagcuacauucuaugucugguuuucgcucaaaaacuuccuggaaaugacaacagcacggcaacgcugugccuugggcaccaugcaguaccaaacgggacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccgggcacggacaaggaccaaaucuuccuguaugcucaaucaucaggaagaaucacaguaucuaccaaaagaagccaacaagcuguaaucccgaauaucggauccagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaggucgaagggagaauucaagaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 39982 - RNA, 1701 nt, Artificial Sequence
  hemagglutinin__InfluenzaA__AFN19493
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauagcuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguauccaccaaaagaagccaacaaacuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39983 - RNA, 1701 nt, Artificial Sequence
  hemagglutinin__InfluenzaA__AFN19495
augaagaccaucauugcuuugagcuacauucuaugucugguuuucgcucaaaaaauuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccacaucauguuuuuugcuuuguguugcuuuguugggguucaucaugugggccugccaaaaaggcaacauuaggugcaacauuugcauuuga

SEQ ID NO: 39984 - RNA, 1701 nt, Artificial Sequence
  hemagglutinin__InfluenzaA__AFN19497
augaagacuaucauugcuuugagcuacauucuaugucugguuuucgcucaaaaacuuccugaaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuauacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuacaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaaccuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 39985 - RNA, 1701 nt, Artificial Sequence; identical to SEQ ID NO: 39935
  hemagglutinin__InfluenzaA__AFN19499

SEQ ID NO: 39986 - RNA, 1701 nt, Artificial Sequence; identical to SEQ ID NO: 39934
  hemagglutinin__InfluenzaA__AFN19501

SEQ ID NO: 39987 - RNA, 1701 nt, Artificial Sequence; identical to SEQ ID NO: 38264
  hemagglutinin__InfluenzaA__AFN19503

SEQ ID NO: 39988 - RNA, 1701 nt, Artificial Sequence; identical to SEQ ID NO: 39935
  hemagglutinin__InfluenzaA__AFN19507

SEQ ID NO: 39989 - RNA, 1701 nt, Artificial Sequence; identical to SEQ ID NO: 39934
  hemagglutinin__InfluenzaA__AFN19509

SEQ ID NO: 39990 - RNA, 1701 nt, Artificial Sequence
  hemagglutinin__InfluenzaA__AFN19513
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaauauuugcauuuga

SEQ ID NO: 39991 - RNA, 1701 nt, Artificial Sequence
  hemagglutinin__InfluenzaA__AFN19515
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaguaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauaugucgaggacacuaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39992 - RNA, 1701 nt, Artificial Sequence; identical to SEQ ID NO: 39935
  hemagglutinin__InfluenzaA__AFN19517

SEQ ID NO: 39993 - RNA, 1701 nt, Artificial Sequence; identical to SEQ ID NO: 39935
  hemagglutinin__InfluenzaA__AFN19519

SEQ ID NO: 39994 - RNA, 1701 nt, Artificial Sequence
  hemagglutinin__InfluenzaA__AFN19521
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucgucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39995 - RNA, 1701 nt, Artificial Sequence
  hemagglutinin__InfluenzaA__AFN19523
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaguaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauaugucgaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 39996 - RNA, 1701 nt, Artificial Sequence
  hemagglutinin__InfluenzaA__AFN19527
augaagacuaucauugcuuugagcuacacucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuucauuugccauaucauguuuuuugcuuuguguugcuuuguugggguucaucaugugggccugccaaaagggcaacauuaggugcaacauuugcauuuga

SEQ ID NO: 39997 - RNA, 1701 nt, Artificial Sequence
  hemagglutinin__InfluenzaA__AFN19529
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuucauuugccauaucauguuuuuugcuuuguguugcuuuguugggguucaucaugugggccugccaaaagggcaacauuaggugcaacauuugcauuuga

SEQ ID NO: 39998 - RNA, 1701 nt, Artificial Sequence
  hemagglutinin__InfluenzaA__AFN19531
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaagagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggcuugccaaaagggcaacauuaggugcaacauuugcauuuga

SEQ ID NO: 39999 - RNA, 1701 nt, Artificial Sequence
  hemagglutinin__InfluenzaA__AFN19533
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacauuggaguuuaacaaugaaagcuucaauuggacuggagucacucaaaacggaacaaguucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40000 - RNA, 1701 nt, Artificial Sequence
  hemagglutinin__InfluenzaA__AFN19535
augaagacuaucauugcuuugagcuacauucuaugucugguuuucgcucaaaaaauuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugaucaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggcuugccaaaagggcaacauuaggugcaacauuugcauuuga

SEQ ID NO: 40001 - RNA, 1701 nt, Artificial Sequence
  hemagglutinin__InfluenzaA__AFN19537
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuguggauuuccuuugccauaucauguuuuuugcuuuguguugcuuuguugggguucaucaugugggccugccaaaagggcaacauuaggugcaacauuugcauuuga

SEQ ID NO: 40002 - RNA, 1701 nt, Artificial Sequence
  hemagglutinin__InfluenzaA__AFN19539
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucuggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauaaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggacgguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggcuugccaaaagggcaacauuaggugcaacauuugcauuuga

SEQ ID NO: 40003 - RNA, 1701 nt, Artificial Sequence; identical to SEQ ID NO: 39928
  hemagglutinin__InfluenzaA__AFN19543

SEQ ID NO: 40004 - RNA, 1701 nt, Artificial Sequence
  hemagglutinin__InfluenzaA__AFN19545
augaagacuaucauugcuuugagcuacauucuaugucugguuuucgcucaaaaacuuccuggaagugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuucaaaaauaagaaaugggaccuuuuuguugaacgaagcaaagccuacagcaacuguuauccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccagcauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggauacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40005 - RNA, 1701 nt, Artificial Sequence; identical to SEQ ID NO: 39928
  hemagglutinin__InfluenzaA__AFN19547

SEQ ID NO: 40006 - RNA, 1701 nt, Artificial Sequence
  hemagglutinin__InfluenzaA__AFN19549
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugaacugguucagaguuccucaaaaggugaaauaugcaacaguccucaucagauccuugauggaggaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcaugaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaacgagaaauuccaucagauugaaaaagaauucucagaagucgaagggaggauucaggacauugagaaauauguugaggacacuaagauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40007 - RNA, 1701 nt, Artificial Sequence
  hemagglutinin__InfluenzaA__AFN19551
augaagacuaucauugcuuugagcuacauucuaugucugguuuucgcucaaaaaauuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucauugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugaucaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaacaaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggcuugccaaaagggcaacauuaggugcaacauuugcauuuga

SEQ ID NO: 40008 - RNA, 1701 nt, Artificial Sequence; identical to SEQ ID NO: 39963
  hemagglutinin__InfluenzaA__AFN19553

SEQ ID NO: 40009 - RNA, 1701 nt, Artificial Sequence; identical to SEQ ID NO: 39971
  hemagglutinin__InfluenzaA__AFN19555

SEQ ID NO: 40010 - RNA, 1701 nt, Artificial Sequence
  hemagglutinin__InfluenzaA__AFN19557
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaaucguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugauaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40011 - RNA, 1701 nt, Artificial Sequence
  hemagglutinin__InfluenzaA__AFN19559
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccuaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40012 - RNA, 1701 nt, Artificial Sequence; identical to SEQ ID NO: 39965
  hemagglutinin__InfluenzaA__AFN19561

SEQ ID NO: 40013 - RNA, 1701 nt, Artificial Sequence
  hemagglutinin__InfluenzaA__AFN19563
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuacgaugugccggauuaugccucccuuaggucacuaguugccucauccggaacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccacaucauguuuuuugcuuuguguugcuuuguugggguucaucaugugggccugccaaaagggcaacauuaggugcaacauuugcauuuga

SEQ ID NO: 40014 - RNA, 1701 nt, Artificial Sequence
  hemagglutinin__InfluenzaA__AFN19565
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauagcuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccaggauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaccucuggucauacaacgcggagcuucuuguugcccuggagaaucaacauacaauugaccuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaucgguuccagaucaagggaguugagcugaagucaggguacaaagauuggauccuauggaucuccuuugccauaucauguuuuuugcuuuguguugcuuuguugggguucaucaugugggccugccaaaagggcaacauuaggugcaacauuugcauuuga

SEQ ID NO: 40015 - RNA, 1701 nt, Artificial Sequence
  hemagglutinin__InfluenzaA__AFN19567
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacugggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggcaaugguuguuucaaaauauaccauaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40016 - RNA, 1701 nt, Artificial Sequence; identical to SEQ ID NO: 39928
  hemagglutinin__InfluenzaA__AFN19569

SEQ ID NO: 40017 - RNA, 1701 nt, Artificial Sequence
  hemagglutinin__InfluenzaA__AFN19571
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacacaaaacggaacaagcucugcuugcauaaggagauccaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguauucucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuuaauuaacagcacagggaaucuaauugcuccuagggguuacuucagaauacgaagugggaaaagcucaauaaugagaucagaugcacccauuggcaaaugcaauucugaaugcaucacuccaaauggaagcauucccaaugacaaaccauuucaaaauguaaacaggaucacauacgggcccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuacaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggacauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40018 - RNA, 1701 nt, Artificial Sequence
  hemagglutinin__InfluenzaA__AFN19573
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguucuucaacagguaaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacucagcauugaacgugacuaugccgaacaaggaacaauuugacaaauuguacauuugggggguucaccacccggguacggacaaagaccaaaucucccuguaugcucaagcaucaggaagaaucacagucucuaccaaaaggagccaacaaacuguaaucccgaauaucggaucuagaccccgaguaaggaauaucccuagcagaauaagcaucuauuggacaauaguaaaaccgggagacauacuuuugauuaauagcacagggaaucuaauugcuccuagggguuacuucaaaaugcaaagugggaaaagcucaauaaugagaucagaugcacccauuggcaaaugcaauucugaaugcaucacuccaaauggaagcauucccaaugacaaaccauuccaaaaugugaacagaaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaguuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40019 - RNA, 1701 nt, Artificial Sequence
  hemagglutinin__InfluenzaA__AFN19575
augaagaccaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaauccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucgggucuagacccagaguaaggaauaucccuagcagaauaagcaucuauuggacaauaguaaagccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaaaggaguugagcuuaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40020 - RNA, 1701 nt, Artificial Sequence; identical to SEQ ID NO: 39942
  hemagglutinin__InfluenzaA__AFN19577

SEQ ID NO: 40021 - RNA, 1701 nt, Artificial Sequence
  hemagglutinin__InfluenzaA__AFN19579
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaguaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauaugucgaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40022 - RNA, 1701 nt, Artificial Sequence; identical to SEQ ID NO: 39942
  hemagglutinin__InfluenzaA__AFN19581

SEQ ID NO: 40023 - RNA, 1701 nt, Artificial Sequence; identical to SEQ ID NO: 39942
  hemagglutinin__InfluenzaA__AFN19583

SEQ ID NO: 40024 - RNA, 1701 nt, Artificial Sequence
  hemagglutinin__InfluenzaA__AFN19587
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaguaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauaugucgaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacgaaugugacaaugccugcauaggaucaaucagaaauggaacuuauaaccacgauguauacagagaugaagcauuaaacaaccgguuccagaucaagggaguugaacugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40025 - RNA, 1701 nt, Artificial Sequence; identical to SEQ ID NO: 39934
  hemagglutinin__InfluenzaA__AFN19589

SEQ ID NO: 40026 - RNA, 1701 nt, Artificial Sequence
  hemagglutinin__InfluenzaA__AFN19591
augaagacuaucauugcccuaagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcaugaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucgggucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaauggcaacauuaggugcaacauuugcauuuga

SEQ ID NO: 40027 - RNA, 1701 nt, Artificial Sequence
  hemagglutinin__InfluenzaA__AFN19593
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaguaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacagaaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40028 - RNA, 1701 nt, Artificial Sequence; identical to SEQ ID NO: 39935
  hemagglutinin__InfluenzaA__AFN19595

SEQ ID NO: 40029 - RNA, 1701 nt, Artificial Sequence
  hemagglutinin__InfluenzaA__AFN19599
augaagacuaucauugcuuugagcuacauucuaugucugguuuucgcucaaaaacuuccuggaaaugacaacagcacggcaacgcugugccuuggccaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggggacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40030 - RNA, 1701 nt, Artificial Sequence
  hemagglutinin__InfluenzaA__AFN19601
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40031 - RNA, 1701 nt, Artificial Sequence; identical to SEQ ID NO: 39928
  hemagglutinin__InfluenzaA__AFN19607

SEQ ID NO: 40032 - RNA, 1701 nt, Artificial Sequence; identical to SEQ ID NO: 39942
  hemagglutinin__InfluenzaA__AFN19609

SEQ ID NO: 40033 - RNA, 1701 nt, Artificial Sequence
  hemagglutinin__InfluenzaA__AFN19611
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguagaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40034 - RNA, 1701 nt, Artificial Sequence; identical to SEQ ID NO: 39963
  hemagglutinin__InfluenzaA__AFN19613

SEQ ID NO: 40035 - RNA, 1701 nt, Artificial Sequence
  hemagglutinin__InfluenzaA__AFN19617
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauagcuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuauaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40036 - RNA, 1701 nt, Artificial Sequence
  hemagglutinin__InfluenzaA__AFN19619
augaagacuaucauugcuuugagccacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuaaacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 40037 - RNA, 1701 nt, Artificial Sequence; identical to SEQ ID NO: 39997
  hemagglutinin__InfluenzaA__AFN19623

SEQ ID NO: 40038 - RNA, 1701 nt, Artificial Sequence; identical to SEQ ID NO: 39942
  hemagglutinin__InfluenzaA__AFN19629

SEQ ID NO: 40039 - RNA, 1701 nt, Artificial Sequence
  hemagglutinin__InfluenzaA__AFN19631
augaagacuaucauugcuuugagcuacauucuaugucugguuuucgcucaaaaacuuccugaaaaugacuacagcacggcaacgcugugucuugggcaucaugcaguaccaaacggaacgauagugaaaacaaucacgaaugaccaaauugaaguuacuaaugcuacugagcugguucagaguuccucaacaggugaaauaugcgacaguccucaucagauccuugauggaauaaacugcacacuaauagaugcucuauugggagacccucagugugauggcuuccaaaauaagaagugggaccuuuuuguugaacgaagcaaagccuacagcaacuguuacccuuaugauguuccggauuaugccucccuuaggucacuaguugccucauccggcacacuggaguuuaacaaugaaagcuucaauuggacuggagucacucaaaacggaacaagcucugcuugcauaaggagaucuacuaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaccaucaggaagaaucacaguaucuacaaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcugguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuuuuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40040 - RNA, 1701 nt, Artificial Sequence
  hemagglutinin__InfluenzaA__AFN19633
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaauaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40041 - RNA, 1701 nt, Artificial Sequence
  hemagglutinin__InfluenzaA__AFN19635
augaagacuaucauugcuuugagcuacauucuaugucugguuuucgcucaaaaacuuccugaaaaugacaacagcacggcaacgcugugucuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaauaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaccaucaggaagaaucacaguaucuacaaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40042 - RNA, 1701 nt, Artificial Sequence; identical to SEQ ID NO: 40041
  hemagglutinin__InfluenzaA__AFN19637

SEQ ID NO: 40043 - RNA, 1701 nt, Artificial Sequence; identical to SEQ ID NO: 39928
  hemagglutinin__InfluenzaA__AFN19639

SEQ ID NO: 40044 - RNA, 1701 nt, Artificial Sequence
  hemagglutinin__InfluenzaA__AFN19641
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuucauuugccauaucauguuuuuugcuuuguguugcuuuguugggguucaucaugugggccugccaaaagggcaacauuaggugcaacauuugcauuuga

SEQ ID NO: 40045 - RNA, 1701 nt, Artificial Sequence; identical to SEQ ID NO: 40041
  hemagglutinin__InfluenzaA__AFN19643

SEQ ID NO: 40046 - RNA, 1701 nt, Artificial Sequence; identical to SEQ ID NO: 39928
  hemagglutinin__InfluenzaA__AFN19645

SEQ ID NO: 40047 - RNA, 1701 nt, Artificial Sequence
  hemagglutinin__InfluenzaA__AFN19647
augaagacuaucauugcuuugagcuacauucuaugucugguuuucgcucaaaaacuuccugaaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaguaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaagucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcacugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40048 - RNA, 1701 nt, Artificial Sequence
  hemagglutinin__InfluenzaA__AFN19649
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaagugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40049 - RNA, 1701 nt, Artificial Sequence
  hemagglutinin__InfluenzaA__AFN19653
augaagacuaucauugcuuugagcuacauucuaugucugguuuucgcucaaaaacuuccugaaaaugacaacagcacggcaacgcugugucuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaauaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaaccaucaggaagaaucacaguaucuacaaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaaguugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40050 - RNA, 1701 nt, Artificial Sequence; identical to SEQ ID NO: 39963
  hemagglutinin__InfluenzaA__AFN19663

SEQ ID NO: 40051 - RNA, 1701 nt, Artificial Sequence
  hemagglutinin__InfluenzaA__AFN19665
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacggagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaagauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccaggucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40052 - RNA, 1701 nt, Artificial Sequence
  hemagglutinin__InfluenzaA__AFN19667
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcaugaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40053 - RNA, 1701 nt, Artificial Sequence
  hemagglutinin__InfluenzaA__AFN19669
augaagacuaucauugcuuugagcuacauucuauguaugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccgaauuaugccucccuuaggucacuaguugccucauccggcacacuggaguuuaacaaugaaagcuucaauuggacuggagucacucaaaacggaacaaguucugcuugcaugaggagaucuaauaguaguuucuuuaguagauugaauugguugacccacuuaaacuucaaauauccagcauugaacgugacuaugccaaacaaugaacaauuugacaaauuguacauuugggggguucaccacccggguacggacaaggaccaaaucuuccuguaugcccaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40054 - RNA, 1701 nt, Artificial Sequence
  hemagglutinin__InfluenzaA__AFN19671
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagaaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40055 - RNA, 1701 nt, Artificial Sequence
  hemagglutinin__InfluenzaA__AFN19674
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggcuugccaaaagggcaacauuaggugcaacauuugcauuuga

SEQ ID NO: 40056 - RNA, 1701 nt, Artificial Sequence
  hemagglutinin__InfluenzaA__AFN19676
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauagugaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40057 - RNA, 1701 nt, Artificial Sequence; identical to SEQ ID NO: 39965
  hemagglutinin__InfluenzaA__AFN19678

SEQ ID NO: 40058 - RNA, 1701 nt, Artificial Sequence
  hemagglutinin__InfluenzaA__AFN19682
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccccaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccgaauuaugccucccuuaggucacuaguugccucauccggcacacuggaguuuaacaaugaaagcuucaauuggacuggagucacucaaaacggaacaaguucugcuugcaugaggagaucuaauaguaguuucuuuaguagauugaauugguugacccacuuaaacuucaaauauccagcauugaacgugacuaugccaaacaaugaacaauuugacaaauuguacauuugggggguucaccacccggguacggacaaggaccaaaucuuccuguaugcccaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaagugcaacauuugcauuuga

SEQ ID NO: 40059 - RNA, 1701 nt, Artificial Sequence
  hemagglutinin__InfluenzaA__AFN19684
augaagacuaucauugcuuugagcuacauucuaugucuggcuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40060 - RNA, 1701 nt, Artificial Sequence
  hemagglutinin__InfluenzaA__AFN19686
augaagacuaucauugcuuugagcuacauucuaugucuggcuuucgcucaaaaacuuccaggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauauaccagagaaacaaacuagaggcauauuuggcgcaauagcggguuucauagaaaaugguugggagggaaugguggaugguugguacgguuucaggcaucaaaauucugagggaagaggacaagcagcagaucucaaaaguacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40061 - RNA, 1701 nt, Artificial Sequence
  hemagglutinin__InfluenzaA__AFN19688
augaagacuaucauugcuuugagcuacauucuaugucugguuuucgcucaagaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaucgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40062 - RNA, 1701 nt, Artificial Sequence
  hemagglutinin__InfluenzaA__AFN19690
augaagacuaccauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugcaucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcagcugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugaucugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40063 - RNA, 1701 nt, Artificial Sequence
  hemagglutinin__InfluenzaA__AFN19692
augaagacuaucauugcuuugagcuacauucuaugucugguuuucgcucaaaaaauuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucaucaggcacacuggaguuuaacaaugaaagcuucaauuggacuggagucacucaaaacggaacaagcucugcuugcauaaggagaucugauaguaguuucuuuaguagauugaauugguugacccacuuaaacuucaaauacccagcauuaaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcugugaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggaaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggaaaaccaacauacaauugaucuaacugacucagaaaugaacaaacuguuugaaaaaacaaagaagcaacugagggaaaaugcugaggauaugggcaauggcuguuucaaaauauaccacaaaugugacaaugccugcauaggaucaaucagaaauggaacuuauaaccacgauguauacagagaugaagcauuaaacaaccgguuccagaucaagggaguugagcugaagucgggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40064 - RNA, 1701 nt, Artificial Sequence
  hemagglutinin__InfluenzaA__AFN19694
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccccaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugcaucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguggaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40065 - RNA, 1701 nt, Artificial Sequence
  hemagglutinin__InfluenzaA__AFN19700
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuaccccuaugaugugccggauuaugccucccuuaggucacuaguugccucauccggcacacuggaguuuaacaaugaaagauucaauuggucuggagucacucaaaacggaacaaguucugcuugcaugaggagaucuaauaguaguuucuuuaguagauugaauugguugacccacuuaaacuucaaauacccagcauugaacgugacuaugccaaacaaugaacaguuugacaaauuguacauuugggggguucaccacccggguacggacaaggaccaaaucuuccuguaugcucaaucaucaggaagaaucacaguaucuaccaaaagaagccaacaagccguaaucccgaauaucggaucuagacccagaauaagaaauaucccuagcagaauaagcaucuauuggacaauaguaaaaccgggagacauacuuuugauuaacagcacagggaaccuaauugcuccuagggguuacuucaaaauacgaagugggaaaagcucaauaaugagaucagaugcacccauuggcaaaugcaauucugaaugcaucacuccaaauggaagcauucccaacgacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaaaaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40066 - RNA, 1701 nt, Artificial Sequence
  hemagglutinin__InfluenzaA__AFN19702
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaggcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40067 - RNA, 1701 nt, Artificial Sequence
  hemagglutinin__InfluenzaA__AFN19709
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaccaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40068 - RNA, 1701 nt, Artificial Sequence
  hemagglutinin__InfluenzaA__AFN19719
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaacccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggguuuaccagauuuuggcgaucuauucaacugucgccaguucauugguacugguagucucccugggggcaaucaguuuuuggaugugcucuaaugggucucuacaguguagaauauguauuuaa

SEQ ID NO: 40069 - RNA, 1701 nt, Artificial Sequence
  hemagglutinin__InfluenzaA__AFN19730
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacggaaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagucucccauuucaaaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaaaguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40070 - RNA, 1701 nt, Artificial Sequence
  hemagglutinin__InfluenzaA__AFN19736
augaaggcaauacuaguagugcugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaccaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40071 - RNA, 1701 nt, Artificial Sequence
  hemagglutinin__InfluenzaA__AFN19748
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaacaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacgccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40072 - RNA, 1701 nt, Artificial Sequence; identical to SEQ ID NO: 37415
  hemagglutinin__InfluenzaA__AFN19757

SEQ ID NO: 40073 - RNA, 1701 nt, Artificial Sequence
  hemagglutinin__InfluenzaA__AFN19768
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggggcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaagugaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40074 - RNA, 1701 nt, Artificial Sequence
  hemagglutinin__InfluenzaA__AFN19781
augaaggcaauacuaguaguucugcuauauacauuugcaaccgcaaaugcagacacauuauguauagguuaucaugcgaacaauucaacagacacuguagacacaguacuagaaaagaauguaacagucacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaguggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40075 - RNA, 1701 nt, Artificial Sequence
  hemagglutinin__InfluenzaA__AFN19791
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuccuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuguggggaauucaccauccaucuacuagugcugaccaacaaagucucuaucagaaugcagaugcauauguuuuuguggggacaucaaaauacagcaagaaauucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgauuuauucaacugucgccaguucauugguacugauagucucccugggggcaaucaguuucuggaugugcucuaaugggucucuacaguguagaauauguauuuaa

SEQ ID NO: 40076 - RNA, 1701 nt, Artificial Sequence
  hemagglutinin__InfluenzaA__AFN19806
augaaggcaauacuaguaguucugcuauauacauuugcaaccgcaaaugcagacacauuauguauagguuaucaugcgaacaauucaacagauacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaccaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugcagaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40077 - RNA, 1701 nt, Artificial Sequence
  hemagglutinin__InfluenzaA__AFN19808
augaaggcaauacuaguaguucugcuauauacauuugcaacugcaaaugcagacacauuaugcauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggaucuugggaaauccagagugugaaucacucuccacagcaaacucaugguccuacauuguggaaacauccaguucagacaauggaacguguuacccaggagauuucaucgauuaugaggagcuaagagaacaauugagcucagugucaucauucgaaagguuugagauauuccccaagacaaauucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuugugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaaccugucagacacccaagggugcuauaaacaccagccucccauuucagaauauacauccgaucacaauuggaaaauguccaaaauauguaaacagcaccaaauugagacuggccacaggauugaggaaugucccguccauucaaucuagaggccuauuuggggccauugccgguuucauugaagggggguggacagggaugguagauggaugguacgguuaccaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaccacgauucaaaugugaagaacuuauaugaaaaggugagaagccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40078 - RNA, 1701 nt, Artificial Sequence
  hemagglutinin__InfluenzaA__AFN19814
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccuugugcuauggggcauucaccauccgucuacuacugcugaccaacaaagucucuaucagaaugcagauacauauguuuuuguggggacaucaagauacagcaagaaguucaagccggaaauagcaauaagacccaaaguaagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuucgaauuuuaccacaaaugcgauaacacgugcauggaaagugucaaaaaugggacuuaugacuacccaaaauacucagaggaagcaaaauuaaacagagaggaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40079 - RNA, 1701 nt, Artificial Sequence
  hemagglutinin__InfluenzaA__AFN19816
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40080 - RNA, 1701 nt, Artificial Sequence
  hemagglutinin__InfluenzaA__AFN19821
augaaggcaauacuaguaguucugcuauauacauuugcaaccgcaaaugcagacacauuauguauagguuaucaugcgaacaauucaacagacacuguagacacaguacuagaaaagaauguaacagugacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuacugcugaccaacaaagucucuaucagaaugcagauacauauguuuuuguggggacaucaagauacagcaagaaguuaaagccggaaauagcaauaagacccaaagugagggaucaagaagggagaaugaacuauuacuggacacuaguagagccgggaggcaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauugaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40081 - RNA, 1701 nt, Artificial Sequence
  hemagglutinin__InfluenzaA__AFN19831
augaaggcaauacuaguaguucugcuauauacauuugcaaccgcaaaugcagacacauuauguauagguuaucaugcgaacaauucaacagacacuguagacacaguacuagaaaagaauguaacagugacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaaggauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauugaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40082 - RNA, 1701 nt, Artificial Sequence
  hemagglutinin__InfluenzaA__AFN19849
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaaugugacauugcuggcuggauccugggaaauccagaaugugaaucacucuccacagcaagcucaugguccuacaucguggaaacaucuaguucagacaauggaacgugcuacccaggagauuucaucaauuaugaggagcuaagagagcaauugagcucagugucaucauuugaaagguuugagauauuccccaagacaaguucauggcccaaucaugacucgaacaaagguguaacggcagcauguccucaagcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugcgcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggagacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgauauauucaacugucgccaguucauugguacugguagucucccugggggcaaucaguuucuggaugugcucuaaugggucucuacaguguagaauauguauuuaa

SEQ ID NO: 40083 - RNA, 1701 nt, Artificial Sequence
  hemagglutinin__InfluenzaA__AFN19865
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaagcuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagagaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacacuaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauuaguacugguagucucccugggggcaaucaguuucuggaugugcucuaaugggucucuacaguguagaauauguauuuaa

SEQ ID NO: 40084 - RNA, 1701 nt, Artificial Sequence
  hemagglutinin__InfluenzaA__AFN19875
augaaggcaauacuaguaguucugcuauauacauuugcaaccgcaaaugcagacacauuauguauagguuaucaugcgaacaauucaacagacacuguggacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagaaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuuuuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40085 - RNA, 1701 nt, Artificial Sequence
  hemagglutinin__InfluenzaA__AFN19895
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagaucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaagauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaccaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaauacucagaggaagcaaaauuaaacagagaaguaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40086 - RNA, 1701 nt, Artificial Sequence
  hemagglutinin__InfluenzaA__AFN19905
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccgguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcagggaucaggauaugcagccgaccugaagagcacacagaaugccguugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugauagucucccugggggcaaucaguuuuuggaugugcucuaaugggucucuacaguguagaauauguauuuaa

SEQ ID NO: 40087 - RNA, 1701 nt, Artificial Sequence
  hemagglutinin__InfluenzaA__AFN19915
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacaucguggaaacaucuaguucagacaauggaacgugcuacccaggagauuucaucaauuaugaggagcuaagagagcaauugagcucagugucaucauuugaaagguuugagauauuccccaagacaaguucauggcccaaucaugacucgaacaaagguguaacggcagcauguccucaagcuggagcaaaaagcuucuacaaaaauuuaauauggcuaguuaaaaaaggaaauucauacccaaagcucagcagcuccuacauuaacgauaaagggaaagaaguccucgugcuauggggcauucaccauccaucuacuagugcugaccaacaaagucucuaucagaaugcagaugcauauguuuuuguggggacaucagaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugcgcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40088 - RNA, 1701 nt, Artificial Sequence
  hemagglutinin__InfluenzaA__AFN19922
augaaggcaauacuaguaguugugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauuacauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcagauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccaagauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaucaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacguacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40089 - RNA, 1701 nt, Artificial Sequence
  hemagglutinin__InfluenzaA__AFN19931
augaaggcaauacuaguaguucugcuauauacauuugcaaccgcaaaugcagacacauuauguauagguuaccaugcgaacaauucaacagacacuguagacacaguacuagaaaagaauguaacaguaacacacucugucaaucuucuagaagacaagcauaacgggaaacuaugcaaacuaagagggguagccccauugcauuuggguaaauguaacauugcuggcuggauccuggguaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauuuggcuaguuaaaaaagggaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaacgugaagaacuuauaugaaaaggugagaaaccaguuaaaaaacaaugccaaggaaauuggaaauggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40090 - RNA, 1701 nt, Artificial Sequence
  hemagglutinin__InfluenzaA__AFN19941
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccuggggaauccagagugugaaucacucuccacagcaagcucaugguccuacaucguggaaacaucuauuucagacaauggaacgugcuacccaggagauuucaucaauuaugaggagcuaagagagcaauugagcucggugucaucauuugaaagguuugagauauuccccaagacaaguucauggcccaaucaugacucgaacaaagguguaacggcagcauguccucaagcuggagcaaaaagcuucuacaaaaauuuaauauggcuaguuaaaaaaggaaauucauacccaaagcucagcaaauccuacauuaacgauaaagggaaagaaguccucgugcuguggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugcgcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugugacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40091 - RNA, 1701 nt, Artificial Sequence
  hemagglutinin__InfluenzaA__AFN19951
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauuaagacuggccacaggauugaggaaugucccgucuauucaaucuagaggccuauuuggggccauugccggcuucauugaagggggguggacagggaugguagacggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40092 - RNA, 1701 nt, Artificial Sequence; identical to SEQ ID NO: 37319
  hemagglutinin__InfluenzaA__AFN19966

SEQ ID NO: 40093 - RNA, 1701 nt, Artificial Sequence
  hemagglutinin__InfluenzaA__AFN19972
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauaaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguaguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggguuuaccagauuuuggcgaucuauucaacugucgccaguucauugguacugguagucucccugggggcaaucaguuuuuggaugugcucuaaugggucucuacaguguagaauauguauuuaa

SEQ ID NO: 40094 - RNA, 1701 nt, Artificial Sequence
  hemagglutinin__InfluenzaA__AFN19978
augaaagcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugugauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40095 - RNA, 1701 nt, Artificial Sequence
  hemagglutinin__InfluenzaA__AFN19983
augaaggcaauacuaguagugcugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaccaaaaugagcaggggucaggauaugcagcugaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40096 - RNA, 1701 nt, Artificial Sequence
  hemagglutinin__InfluenzaA__AFN19993
augaaggcaauacuaguaguucugcuauauacaguugcaaccacaaaugcagacacauuauguauagguuaccaugcgaacaauucaacagacacuguagacacaguacuagaaaagaauguaacaguaacacacucugucaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagauuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaaacucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40097 - RNA, 1701 nt, Artificial Sequence; identical to SEQ ID NO: 37319
  hemagglutinin__InfluenzaA__AFN20000

SEQ ID NO: 40098 - RNA, 1701 nt, Artificial Sequence; identical to SEQ ID NO: 37326
  hemagglutinin__InfluenzaA__AFN20006

SEQ ID NO: 40099 - RNA, 1701 nt, Artificial Sequence
  hemagglutinin__InfluenzaA__AFN20012
augaaggcaauacuaguaguucugcuauauacauuugcaaccgcaaaugcagacacauuauguauagguuaccaugcgaacaauucaacagacacuguagacacaguacuagaaaagaauguaacaguaacacacucugucaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagaacaauugagcucagugucaucauuugaaagauuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40100 - RNA, 1701 nt, Artificial Sequence
  hemagglutinin__InfluenzaA__AFN20018
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacaucguggaaacaucuaguucagacaauggaacgugcuacccaggagauuucaucaauuaugaggagcuaagagagcaauugagcucagugucaucauuugaaagguuugagauauuccccaagacaaguucauggcccaaucaugacucgaacaaagguguaacggcagcauguccucaagcuggagcaaaaagcuucuacaaaaauuuaauauggcuaguuaaaaaaggaaauucauacccaaagcucagcaacuccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugcgcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40101 - RNA, 1701 nt, Artificial Sequence
  hemagglutinin__InfluenzaA__AFN20019
augaaagcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggcaacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaaucggaaauggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40102 - RNA, 1701 nt, Artificial Sequence
  hemagglutinin__InfluenzaA__AFN20021
augaaggcaauacuaguaguucugcuauauacauuugcaaccgcaaaugcagacacauuauguauagguuaccaugcgaacaauucaacagacacuguagacacaguacuagaaaagaauguaacaguaacacacucugucaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacaugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40103 - RNA, 1701 nt, Artificial Sequence; identical to SEQ ID NO: 37328
  hemagglutinin__InfluenzaA__AFN20034

SEQ ID NO: 40104 - RNA, 1701 nt, Artificial Sequence
  hemagglutinin__InfluenzaA__AFN20040
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaccaaaaugagcaggggucaggauaugcagccgaccugaagagcacacagaaugccauugacaagauuacuaacaaaguaaauucuguuauugaaaagaugaauacacaauucacagcaguagguaaagaguucaaccaccuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40105 - RNA, 1701 nt, Artificial Sequence
  hemagglutinin__InfluenzaA__AFN20046
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagacggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40106 - RNA, 1701 nt, Artificial Sequence
  hemagglutinin__InfluenzaA__AFN20052
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguagaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaaucgaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40107 - RNA, 1701 nt, Artificial Sequence; identical to SEQ ID NO: 40078
  hemagglutinin__InfluenzaA__AFN20061

SEQ ID NO: 40108 - RNA, 1701 nt, Artificial Sequence
  hemagglutinin__InfluenzaA__AFN20076
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagauugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcugguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40109 - RNA, 1701 nt, Artificial Sequence
  hemagglutinin__InfluenzaA__AFN20081
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagaucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugauaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaagauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaccaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaauacucagaggaagcaaaauuaaacagagaaguaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40110 - RNA, 1701 nt, Artificial Sequence
  hemagglutinin__InfluenzaA__AFN20092
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguagaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaucugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaaucgaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40111 - RNA, 1701 nt, Artificial Sequence; identical to SEQ ID NO: 40090
  hemagglutinin__InfluenzaA__AFN20099

SEQ ID NO: 40112 - RNA, 1701 nt, Artificial Sequence
  hemagglutinin__InfluenzaA__AFN20112
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauagcuggcuggauccugggaaauccagaguguaaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucauaacccgaacaaagguguaacggcagcauguccucaugcuggagcaaaaagcuucuacaaaaauuuaauauggcuaguuaaaaacggaaauucauacccaaagcucaacacauccuauauuaaugauaaagggaaagaaguccucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggugccgagauaugcauucgcaauggaaagaaaugcgggaucugguauuaucauuucagauacaucaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucucgaggccuauuuggggccauugccgguuucauugaagggggguggacagggaugguagauggaugguacgguuaucaucaucaaaaugagcaggggucaggauaugcagccgaccugaagagcacacagaaugccuuugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaccaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauaugcauuuaa

SEQ ID NO: 40113 - RNA, 1701 nt, Artificial Sequence
  hemagglutinin__InfluenzaA__AFN87924
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauagcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcacauccuauauuaaugauaaaaggaaagaaguccucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggugccgagauaugcauucgcaauggaaagaaaugcgggaucugguauuaucauuucagauacaucaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucucgaggccuauuuggggccauugccgguuucauugaagggggguggacagggaugguagauggaugguacgguuaucaucaucaaaaugaacaggggucaggauaugcagccgaccugaagagcacacagaaugccuuugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40114 - RNA, 1701 nt, Artificial Sequence; identical to SEQ ID NO: 35014
  hemagglutinin__InfluenzaA__AFN87926

SEQ ID NO: 40115 - RNA, 1701 nt, Artificial Sequence
  hemagglutinin__InfluenzaA__AFN87927
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucgucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaaaggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagguacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacagaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaaccuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40116 - RNA, 1701 nt, Artificial Sequence
  hemagglutinin__InfluenzaA__AFN87928
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacuggcagucucccugggggcaaucaguuucuggaugugcucuaaugggucucuacaguguagaauauguauuuaa

SEQ ID NO: 40117 - RNA, 1701 nt, Artificial Sequence
  hemagglutinin__InfluenzaA__AFN87929
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugaacaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40118 - RNA, 1701 nt, Artificial Sequence; identical to SEQ ID NO: 40117
  hemagglutinin__InfluenzaA__AFN87930

SEQ ID NO: 40119 - RNA, 1701 nt, Artificial Sequence
  hemagglutinin__InfluenzaA__AFN87931
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagaaaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaaguaucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40120 - RNA, 1701 nt, Artificial Sequence
  hemagglutinin__InfluenzaA__AFN87932
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugccggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40121 - RNA, 1701 nt, Artificial Sequence; identical to SEQ ID NO: 34337
  hemagglutinin__InfluenzaA__AFN87933

SEQ ID NO: 40122 - RNA, 1701 nt, Artificial Sequence
  hemagglutinin__InfluenzaA__AFN87934
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcaguuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40123 - RNA, 1701 nt, Artificial Sequence
  hemagglutinin__InfluenzaA__AFN87936
augaaggcaauacuaguaguucugcuauauacauuugcaaccgcaaaugcagacacauuauguauagguuaucaugcgaacaauucaacagacacuguagacacgguacuagaaaagaauguaacaguaacacacucuguuaaccuucuagaagacaagcauaacgggaaacuaugcaaacuaagaggaguagccccauugcauuuggguaaauguaacauagcuggcuggauccugggaaauccagagugugaaucacucuccacagcaagcucaugguccuacauuguggaaacaucuauuucagacaauggaacguguuacccaggagauuucaucgauuaugaggagcuaagagagcaauugagcucagugucaucauuugaaagauuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcacauccuauauuaaugauaaagggaaagaaguccucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggugccgagauaugcauucgcaauggaaagaaaugcgggaucugguauuaucauuucagauacaucaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggauugucccgucuauucaaucucgaggccuauuuggggccauugccgguuucauugaagggggguggacagggaugguagauggaugguacgguuaucaucaucaaaaugagcaggggucaggauaugcagccgaccugaagagcacacagaaugccuuugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40124 - RNA, 1701 nt, Artificial Sequence
  hemagglutinin__InfluenzaA__AFN87938
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauccgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacauccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40125 - RNA, 1701 nt, Artificial Sequence
  hemagglutinin__InfluenzaA__AFN87939
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauagcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcacauccuacauuaaugauaaagggaaagaaguccucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaucaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucucgaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40126 - RNA, 1701 nt, Artificial Sequence
  hemagglutinin__InfluenzaA__AFN87941
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40127 - RNA, 1701 nt, Artificial Sequence
  hemagglutinin__InfluenzaA__AFN87943
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauagcuggcuggauccugggaaauccagagugugaaucacucuccacagcaagcucaugguccuacauuguggaaacaucuauuucagacaauggaacguguuacccaggagauuucaucgauuaugaggagcuaagagagcaauugagcucagugucaucauuugaaagauuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcacauccuauauuaaugauaaagggaaagaaguccucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggugccgagauaugcauucgcaauggaaagaaaugcgggaucugguauuaucauuucagauacaucaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucucgaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40128 - RNA, 1701 nt, Artificial Sequence
  hemagglutinin__InfluenzaA__AFN87945
augaaggcaauacuaguaguucugcuauauacauuugcaaccgcaaaugcagacacauuauguauagguuaucaugcgaacaauucaacagacacaguagacacuguacuagaaaagaaugugacaguaacacacucuguuaaccuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagauaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagccaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaaaccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaucaccuggaaaaaagaauagaaaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauugaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40129 - RNA, 1701 nt, Artificial Sequence
  hemagglutinin__InfluenzaA__AFN87947
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauagcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcacauccuacauuaaugauaaagggaaagaaguccucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaucaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucucgaggccuauuuggggccauugccgguuucauugaagggggguggacagggaugguagauggaugguacgguuaucaucaucaaaaugagcaggggucaggauaugcagccgaccugaagagcacacagaaugccuuugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40130 - RNA, 1701 nt, Artificial Sequence
  hemagglutinin__InfluenzaA__AFN87949
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggauucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40131 - RNA, 1701 nt, Artificial Sequence
  hemagglutinin__InfluenzaA__AFN87951
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaguuuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaguaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccaucgacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuauccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40132 - RNA, 1701 nt, Artificial Sequence
  hemagglutinin__InfluenzaA__AFN87953
augaaggcaauacuaguaguucugcuauauacauuugcaaccgcaaaugcagacacauuauguauagguuaucaugcgaacaauucaacagacacuguagacacaguacuagaaaagaauguaacaguaacacacucugcuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugaccugaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauacaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacaaaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauauggacuuacaaugccgaacuguugguucuauuggaaaaugaaagaacuuuggacuaccacgauucaaaugugaagaauuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40133 - RNA, 1701 nt, Artificial Sequence
  hemagglutinin__InfluenzaA__AFN87955
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuccuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccuugugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40134 - RNA, 1701 nt, Artificial Sequence
  hemagglutinin__InfluenzaA__AFN87957
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauagcuggcuggauccugggaaauccagagugugaaucacucuccacagcaagcucaugguccuacauuguggaaacaucuauuucagacaauggaacguguuacccaggagauuucauugauuaugaggagcuaagagagcaauugagcucagugucaucauuugaaagauuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcacauccuauauuaaugauaaagggaaagaaguccucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggugccgagauaugcauucgcaauggaaagaaaugcgggaucugguauuaucauuucagauacaucaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucucgaggccuauuuggggccauugccgguuucauugaagggggguggacagggaugguagauggaugguacgguuaucaucaucaaaaugagcaggggucaggauaugcagccgaccugaagagcacacagaaugccuuugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacaagugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40135 - RNA, 1701 nt, Artificial Sequence
  hemagglutinin__InfluenzaA__AFN87959
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40136 - RNA, 1701 nt, Artificial Sequence
  hemagglutinin__InfluenzaA__AFN87961
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauaugguuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 40137 - RNA, 1698 nt, Artificial Sequence
  hemagglutinin__InfluenzaA__AFO64802
augaaagcaaaacuacuaguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuucuaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucggcaucaugcucccauaaugggaaaagcaguuuuuacagaaauuugcuauggcugacggugaagaauggcuuguacccaaaccugagcaaguccuauguaaacaacaaagggaaagaaguccuuguacuaugggguguucaucacccgucuaacauaagggaccaaagggccaucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugauagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggauuucuagacauuuggacauauaaugcagaauuguugguacuacuggaaaaugaaaggacuuuggauuuccaugacucaaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucacugguucuuuuggucucccugggggcaaucagcuucuggauguguuccaaugggucuuugcaguguagaauaugcaucuga

SEQ ID NO: 40138 - RNA, 1701 nt, Artificial Sequence
  hemagglutinin__InfluenzaA__AFO64813
augaaagcaaaacuacuaguccuguuaugugcauuuacagcuacagaugcagacacaauauguauaggcuaccaugcgaacaacucaaccgacacuguugacacaguacuugaaaagaacgugacagugacacacucugucaaccuacuugaggacagucacaacggaaagcuaugucgacuaaaaggaauagccccacuacaauuggguaauugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggagcaauugaguucaguaucaucauucgagagauucgaaauauuccccaaagaaagcucauggcccaaccacaccguaaccaaaggaguaacggcaucaugcucccauaaggggagaagcaguuuuuacagaaauuugcuauggcuaacggagaagaauggcucguacccaaaucugagcaaguccuaugugaacaacaaagagaaagaaguccuuguacuaugggguguucaucacccgucuaacauaagggaccaaagggccaucuaucauacagaaaaugcuuaugucucuguagugucuucacauuauaacaggagauucaccccagaaauagcaaaaagacccaaaguaagagaucaagaaggaaggauuaacuacuacuggacucugcuggaacccggggacacaauaauauuugaggcaaauggaaaucuaauagcgccaugguaugcuuucgcacugaguagaggcuuugggucaggaaucaucaccucaaaugcaucaauggaugaaugugacgcgaagugucaaacaccccagggagcuauaaacaguagucuuccuuuccagaauguacacccagucacaauaggagagugcccaaaguaugucaggaguacaaaauuaaggaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaucaaaaaagcacacaaaaugccauuaacgggauuacaaacaaggugaauucuguaaucgagaaaaugaacacucaauucacagcugugggcaaagaauucaacaaauuagaaagaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaagugugaaaaauggaacuuaugacuauccaaaauauuccgaggaaucaaaauuaaacagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 40139 - RNA, 1701 nt, Artificial Sequence
  hemagglutinin__InfluenzaA__AFO64824
augaaagcaauacuacuaguccuguuaugugcauuuacagcuacagaugcagacacaauauguauaggcuaccaugcgaacaacucaaccgacacuguugacacaguacuugaaaagaacgugacagugacacauucugucaaccuacuugaggacagucacaacggaaaacuaugucgacuaaaaggaauagccccacuacaauuggguaauugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggagcaauugaguucaguaucaucauucgagagauucgaaauauuccccaaagaaagcucauggcccaaccacaccguaaccaaaggaguaacggcaucaugcucccauaaggggagaagcaguuuuuacagaaauuugcuauggcugacggagaagaauggcuuguacccaaaucugagcaaguccuaugugaacaacaaagagaaagaaguccuuguacuaugggguguucaucacccgucuaacauaggggaccaaagggccaucuaucauacagaaaaugcuuaugucucuguagugucuucacauuauaacaggagauucaccccagaaauagcaaaaagacccaaagucagaggucaagaaggaagaauuaacuacuacuggacucugcuggaacccggggacacaauaauauuugaggcaaauggaaaucuaauagcgccaugguaugcuuucgcacugaguagaggcuuuggaucaggaaucaucaccucaaacgcaucaauggaugaaugugacgcgaagugucaaacaccccagggagcuauaaacaguagucuuccuuuccagaauguacacccagucacaauaggagagugcccaaaguaugucaggaguacaaaauuaaagaugguuacaggacuaaggaacaucccauccauucaauccagaggucuguuuggagccauugccgguuucauugaagggggguggacuggaaugauagauggaugguaugguuaucaucaucagaaugaacaaggaucuggcuaugcugcggaucaaaaaagcacacaaaaugccauuaacgggauuacaaacaaggugaauucuguaaucgagaaaaugaacacucaauucacagcugugggcaaagaauucaacaaauuagaaaaaaggauggaaaauuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaaaccaauuaaagaauaaugccaaagaaauaggaaacggguguuuugaauucuaccacaaguguaacaaugaaugcauggaaagugugaaaaauggaacuuaugacuaucccaaauauuccgaggaaucaaaauuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcauuuga

SEQ ID NO: 40140 - RNA, 1701 nt, Artificial Sequence
  hemagglutinin__InfluenzaA__AFO64835
augaaagcaaaacuacuaguccuguuaugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugucgacuaaaaggaauagccccacuacaauuggguaauugcagcguugccggauggaucuuaggaaacccagaaugcgaaucacuguuuucuaaggaaucaugguccuacauugcagaaacaccagacccugagaauggaacauguuacccaggguauuucgccgacuaugaggaacugagggagcaauugaguucaguaucaucauucgagagauucgaaauauuccccaaggaaagcucauggcccaaccacaccguaaccaaaggaguaacggcaucaugcucccauaaugggaaaagcaguuuuuacagaaauuugcuauggcugacgaagaagaauggcuuguacccaaaucugagcaaguccuauguaaacaacaaagagaaagaaguccuuguacuaugggguguucaucacccgucuaacauaggggaacaaagggccaucuaucauacagaaaaugcuuaugucucuguagugucuucacauuauagcagaagauucaccccagaaauagcaaaaagacccaaaguaagagaucaagaaggaagaaucaacuacuacuggacucugcuggaacccggggacacaauaauauuugaggcaaauggaaaucuaauagcgccaugguacgcuuucgcacugaguagaggcuuugggucaggaaucaucaccucaaacgcaucaauggaugagugugacgcuaagugucaaacaccccaaggagcuauaaacaguagucuuccuuuccagaauguacacccagucacaauaggagaguguccaaaguaugucaggaguacaaaauuaaggaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaccaaaaaagcacacaaaaugccauuaacgggauuacaaacaaggugaauucuguaaucgagaaaaugaacacucaauucacagcuguaggcaaagaauucaacaaauuagaaagaaggauggaaaacuuaaauaagaaaguugaugauggauuucuggacauuuggacauauaaugcagaauuguugguucuccuggaaaaugaaaggacuuuggauuuucaugacucaaaugugaagaaucuguaugagaaaguaaaaaaccaauugaagaauaaugccaaagaaauagggaacggguguuuugaauucuaucacaaguguaacaaugaaugcauggaaagugugaaaaauggaacuuaugacuauccaaaauauuccgaagaaucaaaguuaaacagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 40141 - RNA, 1701 nt, Artificial Sequence
  hemagglutinin__InfluenzaA__AFO64846
augaaagcaaaacuacuaguccuguuaugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugucgacuaaaaggaauagccccacuacaauuggguaauugcagcguugccggauggaucuuaggaaacccagaaugcgaaucacuguuuacuaaggaaucaugguccuacauugcagaaacuccaaacccugagaauggaacauguuacccaggguauuucgcagacuaugaagaacugagggagcaauugaguucaguaucaucauucgagagauucgaaauauuccccaaagaaagcucauggcccaaccacaccguaacuaaaggaguaacggcaucaugcucccauaaugggaaaagcaguuuuuacagaaauuugcuauggcugacggagaagaauggcuuguacccaaaucugagcaaguccuauguaaacaacaaagagaaagaaguccuuguacuaugggguguucaucacccgucuaacaugggggaccaaagggccaucuaucauacagaaaaugcuuauguuucuguagugucuucacauuauagcagaagauucaccccagaaauagcaaaaagacccaaaguaagaggucaagaaggaagaauuaacuacuacuggacucugcuggaacccggggacacaauaauauuugaggcaaauggaaaucuaauagcgccaagguaugcuuucgcacugaguagaggcuuugggucaggaaucaucaccucaaacgcaucaauggaugaaugugacgcgaagugucaaacaccccaaggagcuauaaacaguagucuuccuuuccagaacguacacccagucacaauaggagaguguccaaaguaugucaggaguacaaaauuaaggaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaccaaaaaagcacacaaaaugccauuaacgggauuacaaacaaggugaauucuguaaucgagaaaaugaacacucaauucacagcugugggcaaagaauucaacaaauuagaaagaaggauggaaaacuugaacaaaaaaguugaugauggauuucuggacauuuggacauauaaugcagaauuguugguucuacuggaaaaugaaaggacuuuggauuuucaugacucaaaugugaagaaucuguaugagaaaguaaaaagccaacugaagaauaaugccaaagaaauagggaacggguguuuugaauucuaucacaaguguaacaaugaaugcauggaaagugugaaaaauggaacuuaugacuauccaaaauauuccgaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggaugugcucuaaugggucuuugcaguguagaauaugcaucuga

SEQ ID NO: 40142 - RNA, 1701 nt, Artificial Sequence
  hemagglutinin__InfluenzaA__AFO64857
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacaccguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguagugucuucacauuauagcagaagauucaccccagaaauagcaaaaagacccaaaguaagaggucaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaccgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagaccaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaauggaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaacagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 40143 - RNA, 1701 nt, Artificial Sequence
  hemagglutinin__InfluenzaA__AFO64868
augaaaguaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguguuucgccgacuaugaggaacugagggagcaauugagcucaguaucaucauucgagagauucgaaauauuccccaaggaaagcucauggcccaaccacaccguaaccaaaggagugacggcaucaugcucccauaaugggaaaagcaguuuuuacaaaaauuuacuauggcugacggaaaagaauggcuuguacccaaaccugagcaaguccuauguaaacaacaaggagaaagaaguccuuguacuaugggguguucaucacccgucuaacauaagggaccaaagggccaucuaucauacagaaaaugcuuaugucucuguagugucuucacauuauagcagaagauucaccccagaaauagcaaaaagacccaaaguaagaggucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaccaucagaaugaacaaggaucuggcuaugcugcagaccaaaaaagcacacaaaaugccauugaugggauuacaaacaaggugaauucuguaauugagaaaaugaacacucaauucacagcuguaggcaaagaauucaacaaauuagagagaaggauggaaaacuuaaauaagaaaguugaugauggauuucuggacauuuggacauauaaugcagaguuguugguucuucuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaacagggaaaaaauugauggagugaaauuggaaucaaugggcgucuaucagauucuggcgaucuacucaacugucgccaguucacuggugcuuuuggucucccugggggcaaucaguuucuggauguguucuaaugggucuuugcaguguagaauaugcaucuga

SEQ ID NO: 40144 - RNA, 1698 nt, Artificial Sequence
  hemagglutinin__InfluenzaA__AFO64879
augaaagcaaaacuacuaguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaaucacugauuuuuaaggaaucaugguccuacauuguagagacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucggcaucaugcucccauaaugggaaaagcaguuuuuacagaaauuugcuauggcugacggagaagaauggcuuguacccaaaccugagcaaguccuauguaaacaacaaagagaaagaaguccuuguacuaugggguguucaucacccgucuaacauaagggaccaaagggccaucuaucauacagaaaaugcuuaugucucuguagugucuucacauuauagcagaagauucaccccagaaauagcaaaaagacccaaaguaagaggucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuucccuuccagaauguacacccagucacaauaggagaguguccaaaguaugucaggagugcaaaauuaaggaugguuacaggacuaaggaacaucccauccauccaauccagagguuuguuuggagccauugccgguuucauugaagggggguggacuggaaugauagaugggugguaugguuaucaucaucagaaugagcaaggaucuggcuaugcugcagaccaaaaaagcacacaaaaugcuauuaacgggaucacaaacaaggugaauucuguaauugagaaaaugaacacucaauucacagcugugggcaaagaauucaacaaauuagaaagaaggauggaaaacuuaaauaaaaaaguugaugauggauuucuagacauuuggacauauaaugcagaauuguugguucuacuggaaaaugaaaggacuuuggauuuccaugacucaaaugugaagaaucuguaugagaaaguaaaaagccaauuaaagaauaaugcuaaagaaauaggaaacggguguuuugaauucuaucacaaguguaacaaugaaugcauggaaagugugaaaaaugggacuuaugacuauccaaaauauuccgaagaaucaaaguuaaacagggagaaaauugauggagugaaauuggaaucaaugggagucuaucagauucuggcgaucuacucaacugucgccaguucacugguucuuuuggucucccugggggcaaucagcuucuggauguguuccaaugggucuuugcaguguagaauaugcaucuga

SEQ ID NO: 40145 - RNA, 1698 nt, Artificial Sequence
  hemagglutinin__InfluenzaA__AFO64890
augaaagcaaaacuacuaguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaaucacugauuucuaaggaaucaugguccuacauuguagagacaccaaacccugagaauggaacauguuacccaggguauuucgccgacuaugaggaacugagggagcaauugaguucaguaucuucauuugagagauucgaaauauuccccaaagaaagcucauggcccaaccacaccguaaccggaguaucggcaucaugcucccauaaugggaaaagcaguuuuuacagaaauuugcuauggcugacggagaagaauggcuuguacccaaaccugagcaaguccuauguaaacaacaaagagaaagaaguccuuguacuaugggguguucaucacccgucuaacauaagggaccaaagggccaucuaucauacagaaaaugcuuaugucucuguagugucuucacauuauagcagaagauucaccccagaaauagcaaaaagacccaaaguaagaggucaggaaggaagaaucaacuacuacuggacucugcuggaacccggggacacaauaauauuugaggcaaauggaaaucuaauagcgccaugguaugcuuucgcacugaguagaggcuuugggucaggaaucaucaccucaaaugcaccaauggaugaaugugaugugaagugucagacaccucagggagcuauaaacaguagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugauagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaagguugaugauggauuucuagacauuuggacauauaaugcagaauuguugguucuacuggaaaaugaaaggacuuuggauuuccaugacucaaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucacugguucuuuuggucucccugggggcaaucagcuucuggauguguuccaaugggucuuugcaguguagaauaugcaucuga

SEQ ID NO: 40146 - RNA, 1701 nt, Artificial Sequence
  hemagglutinin__InfluenzaA__AFO64901
augaaagcaaaacuacuaguccuguugugugcauuuacagcuacauaugcagacacaauauguauaggcuaccaugcgaacaauucaacugacacuguugacacaguacuugagaagaacgugacagugacacacucugucaaccuacuugaggacagucacaacggaaaacuaugccgacuaaaaggaacagccccacuacaauuggguaauugcagcauugcuggauggaucuuaggaaauccagaaugcgaaucacuguuuucuaaggaaucaugguccuacauugcagaaacaccaaacccugaaaauggaacauguuacccaggguauuucgccgacuaugaggaacugagggagcaauugagcucaguaucaucauucgaaagauuugaaauauuccccaaggaaagcucauggcccaaccacaccguaaccaaaggagugacggcaucaugcucccauaauggaaaaagcagcuuuuacaaaaauuugcuauggcugacggagaagaauggcuuguacccaaaucugagcaaguccuauguaaacaacaagaaaaaagaaguccuugugcuaugggguguucaucacccgucuaacauaggggaccaaagggccauuuaucauacagaaaaugcuuaugucucuguagugucuucacauuauagcagaagauucaccccagaaauagcaaaaagacccaaaguaagaaaucaagaagggagaauuaacuacuacuggacucugcuggaacccggggacacaauaauauuugaggcaaauggaaaucuaauagcgccaugguacgcuuucgcauugaguagaggcuuugagucaggaaucaucaccucaaacgcaucaaugggugaaugugacgcuaagugucaaacaccucaaggagcuauaaacaguagucuuccuuuccagaauguacacccagucacaauaggggaguguccaaaguaugucaggaguacaaaauuaaggaugguuacaggacuaaggaacaucccauccauucaauccagagguuuguuuggagccauugccgguuucauugaaggaggguggacuggaaugauagauggaugguaugguuaucaucaucagaaugaacaaggaucuggcuaugcugcggaccaaaaaagcacacaaaaugccauuaaugggauuacaaacaaggugaauucuauaaucgagaaaaugaacacucaauucacagcuguaggcaaagaauucaacaaauuagaaagaagaauggagaacuuaaauaagaaaguugaugauggauuucuggacauuuggacauauaaugcagaauuguugguucuccuggaaaaugaaaggacuuuggauuuucaugacucaaaugugaagaaccuguaugagaaaguaaaaaaccaauugaagaauaaugccaaagaaauaggaaacggguguuuugaauucuaucacaaguguaacaaugaaugcauggaaagugugaaaaauggaacuuaugacuauccaaaauauuccaaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcaucuga

SEQ ID NO: 40147 - RNA, 1698 nt, Artificial Sequence
  hemagglutinin__InfluenzaA__AFO65016
augaaagcaaaacuacuaguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuagguaauugcagcguugccggauggaucuuaggaaacccagaaugcgaaucacugauuucuaaagaaucaugguccuacauuguagagacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucggcaucaugcucccauaaugggaaaagcaguuuuuacagaaauuugcuauggcugacgaagaagaauggcuuguacccaaaccugagcaaguccuauguaaacaacaaagagaaagaaguccuuguacuaugggguguucaucacccgucuaacauaggggaccaaaggaccaucuaucauacagaaaaugcuuaugucucuguagugucuucacauuauagcagaagauucaccccagaaauagcaaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugccaaacaccucagggagcuauaaacaguagucuuccuuuccagaauguacacccaaucacaauaggagaguguccaaaguaugucaggagugcaaaauuaaggaugguuacaggacuaaggaacaucccauccauucaauccagagguuuguuuggagccauugccgguuucauugaagggggguggacuggaaugauagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaacuuagaaagaaggauggaaaacuuaaauaaaaagguugaugauggauuucuggacauuuggacauauaaugcagaauuguugguucuacuggaaaaugaaaggacuuuggauuuccaugacucaaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucacugguucuuuuggucucccugggggcaaucagcuucuggauguguuccaaugggucuuugcaguguagaauaugcaucuga

SEQ ID NO: 40148 - RNA, 1698 nt, Artificial Sequence; identical to SEQ ID NO: 32619
  hemagglutinin__InfluenzaA__AFO65027

SEQ ID NO: 40149 - RNA, 1698 nt, Artificial Sequence
  hemagglutinin__InfluenzaA__AFO65038
augaaagcaaaacuacugguccuguuauguacauuuacagcuacauacgcagacacaauauguauaggcuaccaugccaacaacucaaccgacacuguugacacaguacuugagaagaaugugacagugacacacucugucaaucuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauagggaaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 40150 - RNA, 1698 nt, Artificial Sequence
  hemagglutinin__InfluenzaA__AFO66136
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauagggaaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggauuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacgaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuauaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 40151 - RNA, 1701 nt, Artificial Sequence
  hemagglutinin__InfluenzaA__AFO66147
augaaagcaaaacuacuaguucuguugugugcauuuacaacuacauaugcagacacaauauguauaggcuaccaugcgaacaacucaacugacacuguugacacaguacuugagaagaacgugacagugacacacucugucaaccuacuugaggacagucacaacggaaaacuaugccgacuaaaaggaacagccccacuacaauuggguaauugcagcauugccggauggaucuuaggaaauccagaaugcgaaucacuguuuucuaaggaaucaugguccuacauugcagaaacaccaaacccuaaaaauggaacauguuacccaggguauuucgccgacuaugaggaacugagggagcaauugagcucaguaucaucauucgagagauuugaaauauuccccaaggauagcucauggcccaaccacacuguaaccaaaggagugacggcaucaugcucccauaaugggaaaagcagcuuuuacaaaaauuugcuauggcugacggggaagaauggcuuguacccaaaucugagcaaguccuauguaaacaaaaagggaaaagaaguccuugugcuaugggguguucaucacccgucuaacaugggggaccaacgggccaucuaucauaaagaaaaugcuuauguuucuguguugucuucacauuauagcagaagauucaccccagaaauagcaaaaagacccaaaguaagagaucaagaagggagaauuaacuacuacuggacucugcuggaaccuggggacacaauaauauuugaggcaaauggaaaucuaauagcgccgugguacgcuuucgcacugaguagaggcuuugggucaggaaucaucaucucaaacgcaucaaugggugaaugugacgcuaagugucaaacaccccaaggagcuauaaacaguagucuccccuuccagaauguacacccagucacaauaggagaguguccaaaguaugucaggaguacaaaauuaaggaugguuacaggucuaaggaacgucccauccauucaauccagaggguuguuuggagccauugccgguuucauugaaggaggguggacuggaaugauagauggaugguaugguuaucaucaucaaaaugaacaaggaucuggcuaugcugcggaccaaaaaagcacacaaaaugccauuaaugggauuacaaacaaggugaauucuauaaucgagaaaaugaacacucaauucacagcuguaggcaaagaauucaacaaauuagaaagaaggauggaaaacuuaaauaagaaaguugaugauggauuucuggacauuuggacauauaaugcagaauuguuaguucuccuggaaaaugaaaggacuuuggauuuucaugacucaaaugugaagaaccuguaugagaaaguaaaaaaccaauugaagaauaaugccaaagaaauagggaacggguguuuugaauucuaucacaaguguaacaaugaaugcauggaaagugugaaaaauggaacuuaugacuauccaaaauauuccaaagaaucaaaguuaaacagggaaaaaauugauggagugaaauuggaaucaaugggagucuaucagauucuggcgaucuacucaacugucgccaguucgcuggugcuuuuggucucccugggggcaaucagcuucuggauguguucuaaugggucuuugcaguguagaauaugcaucuga

SEQ ID NO: 40152 - RNA, 1698 nt, Artificial Sequence
  hemagglutinin__InfluenzaA__AFO66158
augaaagcaaaacuacugguccuguuauguacauuuacagcuacauacgcagacacaauauguauaggcuaccaugccaacaacucaaccgauacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaagggaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauagggaaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcaccaugguaugcuuuugcacugaguagaggcuuuggaucaggaaucaucaccucaaaugcaccaaugggugaaugugaugcgaagugucaaacaccucagggagcuauaaacaguagucuuccuuuucagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauuuacagcugugggcaaagaauucaacaaauuagaaagaaggauggaaaacuuaaauaaaaaaguugaugauggguuucuagacauuuggacauauaaugcagaauuguugguucuacuggaaaaugaaagaacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauucugaagaaucaaaguuaaacagggagaaaauugauggaguaaaauuggaaucaaugggagucuaucagauucuggcgaucuacucaacugucgccaguuccuugguucuuuuggucucccugggggcaaucagcuucuggauguguuccaaugggucuuugcaguguagaauaugcaucuga

SEQ ID NO: 40153 - RNA, 1698 nt, Artificial Sequence
  hemagglutinin__InfluenzaA__AFO66169
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaacuaugucuauuaaaaggaauagccccacuacaauuggguaauugcagcguugccggauggaucuuaggaaacccagaaugcgaguuacugauuuccaaggaaucaugguccuacauuguagaaacaucaaauccugagaauggaacauguuacccaggguauuucaccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaagggcccucuaucauacagaaaaugcuuaugucucuguagugucuucacauuauagcagaagauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaccucaaaugcaccaauggaugaaugugaugcgaagugccaaacaccucauggagcuauaaacagcagucuuccuuuccagaauguacacccagucacaauaggugaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaguauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 40154 - RNA, 1698 nt, Artificial Sequence
  hemagglutinin__InfluenzaA__AFO66180
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagaaaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugaugggguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 40155 - RNA, 1698 nt, Artificial Sequence
  hemagglutinin__InfluenzaA__AFO66191
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauagggaaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 40156 - RNA, 1698 nt, Artificial Sequence
  hemagglutinin__InfluenzaA__AFO66202
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccccuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauaggggaccaaaggacccucuaucauacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaacgccauuaacgggauuacaaacaaggugaauucuguaauugagaaaaugaacacucaauucacagcugugggcaaagaauucaacaaauuggaaagaaggauggaaaacuuaaauaaaaaaguugaugauggauuucuagacauuuggacauauaaugcagaauuguugguucuacuggaaaaugaaaggacuuuggauuuccacgacuccaaugugaagaaucuguaugagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 40157 - RNA, 1698 nt, Artificial Sequence
  hemagglutinin__InfluenzaA__AFO66213
augaaaguaaaacuacugguccuguuauguacauuuacagcuacauaugcagacacaauauguauaggcuaccaugccaacaacucaaccgacacuguugacacaguacuugagaaaaaugugacagugacacacucugucaacuuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaaaagaaagaaguccuuguacuaugggguguucaucacccgccuaacauagggaaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaccaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagauauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacgaugaaugcauggagaguguaaaaaauggaacuuaugacuauccgaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuga

SEQ ID NO: 40158 - RNA, 1698 nt, Artificial Sequence
  hemagglutinin__InfluenzaA__AFO66224
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauagggaaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaggggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 40159 - RNA, 1698 nt, Artificial Sequence
  hemagglutinin__InfluenzaA__AFO66235
augaaaguaaaacuacugguccuguuaugcacauuuacagcuacauaugcagacacaauauguauaggcuaccaugccaacaacucaaccgacacuguugacacaguacuugaaaagaaugugacagugacacacucugucaaccugcuugaggacagucacaauggaaaacuaugucuauuaaaaggaauagccccacuacaauuggguaauugcagcguugccggguggaucuuaggaaacccagaaugcgaauuacugauuuccaaggaaucaugguccuacauuguagaaaaaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccaaacauagguguccaaagggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 40160 - RNA, 1698 nt, Artificial Sequence
  hemagglutinin__InfluenzaA__AFO66246
augaaaguaaaacuacugguccuguuaugcacauuuacagcuacauaugcagacacaauauguauaggcuaccaugccaacaacucaaccgacacuguugacacaguacuugaaaagaaugugacagugacacacucugucaaccugcuugaggacagucacaauggaaaacuaugucuauuaaaaggaauagccccacuacaauuggguaauugcagcguugccggguggaucuuaggaaacccagaaugcgaauuacugauuuccaaggaaucaugguccuacauuguagaaaaaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccaaacauagguaaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggaugaaugugaugcggagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 40161 - RNA, 1701 nt, Artificial Sequence
  hemagglutinin__InfluenzaA__AFP33324
augaaagcaaaacuacuaguucuguuguguacauuuacagcuacauaugcagacacaauauguauaggcuaccaugcgaacaacucaacugacacuguugacacaguacuugagaagaacgugacagugacacacucugucaaccuacuugaggacagucacaacggaaaacuaugccgacuaaaaggaacagccccacuacaauuggguaauugcagcauugccggauggaucuuaggaaauccagaaugcgaaucacuguuuucuaaggaaucauggucuuacauugcagaaacaccaaacccuaaaaauggaacauguuacccaggguauuucgccgacuaugaggaacugagggagcaauugagcucaguaucaucauucgagagauuugaaauauuccccaaggauagcucauggcccaaccacacuguaaccaaaggagugacggcaucaugcucccauaaugggaaaagcagcuuuuacaaaaauuugcuauggcugacggggaagaauggcuuguacccaaaucugagcaaguccuauguaaacaaaaagggaaaagaaguccuugugcuaugggguguucaucacccgucuaacaugggggaccaacgggccaucuaucauaaagaaaaugcuuauguuucuguguugucuucacauuauagcagaagauucaccccagaaauagcaaaaagaccaaaaguaagagaucaagaagggagaauuaacuacuacuggacucugcuggaacccggggacacaauaauauuugaggcaaauggaaaucuaauagcgccgugguacgcuuucgcacugaguagaggcuuugggucaggaaucaucaucucaaaugcaucaaugggugaaugugacgcuaagugucaaacaccccaaggagcuauaaacaguagucuccccuuccagaauguacacccagucacaauaggagaguguccaaaguaugucaggaguacaaaauuaaggaugguuacaggacuaaggaacgucccauccauucaauccagagguuuguuuggagccauugccgguuucauugaaggaggguggacuggaaugauagauggaugguaugguuaucaucaucaaaaugaacaaggaucuggcuaugcugcggaccaaaaaagcacacaaaaugccauuaaugggauuacaaacaaggugaauucuauaaucgagaaaaugaacacucaauucacagcuguaggcaaagaauucaacaaauuagaaagaaggauggaaaacuuaaauaagaaaguugaugauggauuucuggacauuuggacauauaaugcagaauuguuaguucuccuggaaaaugaaaggacuuuggauuuucaugacucaaaugugaagaaccuguaugagaaagugaaaacccaauugaagaauaaugccaaagaaauagggaacggguguuuugaauucuaucacaaguguaacaaugaaugcauggaaagugugaaaaauggaacuuaugacuauccaaaauauuccaaagaaucaaagcuaaacagggaaaaaauugauggagugaaauuggaaucaaugggagucuaucagauucuggcgaucuacucaacugucgccaguucgcuggugcuuuuggucucccugggggcaaucagcuucuggauguguucuaaugggucucugcaguguagaauaugcaucuga

SEQ ID NO: 40162 - RNA, 1698 nt, Artificial Sequence
  hemagglutinin__InfluenzaA__AFP33325
augaaaguaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauucccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagaaagcucauggcccagccacaccguaaccggaguaucagcaucaugcucucauaaugggaaaagcaguuuuuacagaaauuugcuauggcugacggggaagaaugguuuguacccaaaccugagcaaguccuauucaaacaacaaagagaaagaaguccuuguacuaugggguguucaucacccgccuaacauaggggaccaaagggcccucuaucauacagaaaaugcuuauguuucuguagugucuucacauuauagcagaagauucaccccagaaauagccaaaagacccaaaguaagaggucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacccaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuaa

SEQ ID NO: 40163 - RNA, 1701 nt, Artificial Sequence
  hemagglutinin__InfluenzaA__AFQ32573
augaagacuaucauugcuuugagcuacauucuaugucugguuuucgcucaaaaacuuccuggaaaugacaacagcacggcgacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguuggggacacuaaaauagaucucuggucauacaacgcggagcuucuuguugcccuggagaaccaacacacaauugaucuaacugacucagaaaugaacaaacuguuugaaaaaacaaagaaacaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40164 - RNA, 1701 nt, Artificial Sequence
  hemagglutinin__InfluenzaA__AFQ37281
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggaguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaaucuuauauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagaaccgggagacaaaauaacauucgaagcaacuggaaaucuagugguaccgagauaugcauucgcgauggaaagaaaugcuggaucugguauuaucauuucagauacaccagcccacgauugcaauacaacuugucagacacccaaaggugcuauaaacaccagccucccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgaugacaagugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 40165 - RNA, 1707 nt, Artificial Sequence
  hemagglutinin__InfluenzaA__AFQ55689
augaacacucaaauuuuggcacucauugcuuguaugcugauuggagcuaaaggagauaaaauaugucuugggcaccaugcuguggcaaauggaacaaaagugaacacauuaacagagagaggaaucgaaguaguaaaugccacagaaacgguggagacugcaaauacuaagaaaauaugcacucaggggaaaagaccaacagaucugggacaaugcggacuucuaggaacccuaauaggaccuccccaaugcgaucaauuucuggaauuugacgcugauuuaauaauugaacgaagagaaggaaccgauguguguuaucccgggaaguucacaaaugaagaaucacugaggcaaauccuucgagggucaggaggaauugauaaagagucaauggguuucaccuauaguggaauaagaaccaauggggcgacaagugcuugcagaagaucagguucuuccuucuaugcggagaugaagugguuacugucgaauucagacaaugcggcuuuuccccaaaugacuaagucguacagaaaucccaggaacaaaccagcucugauaauuuggggagugcaucauucuggaucggcuacugagcagaccaaacucuaugggaguggaaacaaguugauaacaguaggaagcucgaaauaccagcagucauucaccccaagcccgggggcacgaccacaggugaaugggcaaucaggaaggauugacuuucacuggcuacuccuugaucccaaugacacagugaccuucacauucaauggggcauucauagcuccugacagagcaaguuucuuuagaggagagucaauaggaguucagagugauguuccuuuggauucugguugugagggggauugcuuccacaauggggguacgauagugaguucccugccauuccagaacaucaacccuagaacagugggaaaaugcccucgauaugucaaacagacaagccuccuuuuggcuacagggaugagaaacgucccagagaaccccaaggauaggaagagccgacaucgaaggaccagaggccuuuuuggagcgauugcuggauucauagagaauggaugggaaggucucauugauggaugguaugguuucagacaucaaaaugcacaaggagaaggaacugcagcugauuacaaaagcacucaaucugcgauagaucagaucacaggcaaauugaaucgucuaauugacaaaacaaaucagcaguuugaacugauagacaacgaauucagugaaauagaacaacaaauugggaaugucauuaacuggacacgagauucaaugacugagguauggucguacaaugcugaauugcugguagcuauggaaaaucagcacacaauagaucuugcagacucagaaaugaacaaacuuuaugagcguguaaggaaacaacugagggagaaugcugaagaggaugggacuggaugcuuugaaauauuucauaagugugaugaucagugcauggagagcaucaggaacaacacuuaugaccauacucaauacagagcggagucauugcagaauagaauacagauagacccagugaaauugaguaguggauacaaagacauaaucuuaugguuuagcuucggggcaucauguuuucuucuucuagccauugcaaugggauugguuuucauuugcauaaagaauggaaacaugcggugcacuauuuguauauag

SEQ ID NO: 40166 - RNA, 1701 nt, Artificial Sequence
  hemagglutinin__InfluenzaA__AFR68153
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40167 - RNA, 1701 nt, Artificial Sequence
  hemagglutinin__InfluenzaA__AFR68163
augaaggcaacacuaguaguucugcuauauacauuugcaaccgcaaaugcagacacauuauguauagguuaccaugcgaacaauucaacagacacuguagacacaguacuagaaaagaauguaacaguaacacacucugccaaucuucuagaagacaagcauaacggaaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauccaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40168 - RNA, 1701 nt, Artificial Sequence
  hemagglutinin__InfluenzaA__AFR68173
augaagacuaucauugcuuugagcuacauucuaugucugguuuucgcccaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaaucugugaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggaaaaugcaauucugaaugcaucacuccaaauggaagcauucccaaugacaaaccauuccaaaauguaaacaggaucacauacggggccuguccuagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggaaaaccaacauacaauugaucuaacugacucagaaaugaacaaacuguuugaaaaaacaaagaagcaacugagagaaaaugcugaagauaugggcaauggcuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40169 - RNA, 1701 nt, Artificial Sequence
  hemagglutinin__InfluenzaA__AFR84675
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugagaaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaucacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40170 - RNA, 1701 nt, Artificial Sequence; identical to SEQ ID NO: 37712
  hemagglutinin__InfluenzaA__AFR84685

SEQ ID NO: 40171 - RNA, 1701 nt, Artificial Sequence; identical to SEQ ID NO: 33390
  hemagglutinin__InfluenzaA__AFR84694

SEQ ID NO: 40172 - RNA, 1701 nt, Artificial Sequence; identical to SEQ ID NO: 33197
  hemagglutinin__InfluenzaA__AFR84704

SEQ ID NO: 40173 - RNA, 1701 nt, Artificial Sequence
  hemagglutinin__InfluenzaA__AFR84714
augaaggcaauacuaguaguucugcuauauacauuugcaaccgcaaaugcagacacauuauguauagguuaucgugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40174 - RNA, 1701 nt, Artificial Sequence; identical to SEQ ID NO: 33390
  hemagglutinin__InfluenzaA__AFR84724

SEQ ID NO: 40175 - RNA, 1701 nt, Artificial Sequence; identical to SEQ ID NO: 33390
  hemagglutinin__InfluenzaA__AFR84734

SEQ ID NO: 40176 - RNA, 1701 nt, Artificial Sequence; identical to SEQ ID NO: 33390
  hemagglutinin__InfluenzaA__AFR84754

SEQ ID NO: 40177 - RNA, 1701 nt, Artificial Sequence; identical to SEQ ID NO: 33390
  hemagglutinin__InfluenzaA__AFR84764

SEQ ID NO: 40178 - RNA, 1701 nt, Artificial Sequence; identical to SEQ ID NO: 33390
  hemagglutinin__InfluenzaA__AFR84774

SEQ ID NO: 40179 - RNA, 1701 nt, Artificial Sequence
  hemagglutinin__InfluenzaA__AFR84784
augaaggcaauacuaguaggucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauauucagaggaagcaaaauuaaacagagaagaaauagaugggguaaagcuggaaucaacaaggauuuaccagauuuuggcgauauauucaacugucgccaguucauuggcacugguagucucccugggggcaaucaguuucuggaugugcucuaaugggucucuacaguguagaauauguauuuaa

SEQ ID NO: 40180 - RNA, 1701 nt, Artificial Sequence; identical to SEQ ID NO: 33390
  hemagglutinin__InfluenzaA__AFR84794

SEQ ID NO: 40181 - RNA, 1701 nt, Artificial Sequence; identical to SEQ ID NO: 33173
  hemagglutinin__InfluenzaA__AFR84804

SEQ ID NO: 40182 - RNA, 1701 nt, Artificial Sequence; identical to SEQ ID NO: 33390
  hemagglutinin__InfluenzaA__AFR84814

SEQ ID NO: 40183 - RNA, 1701 nt, Artificial Sequence; identical to SEQ ID NO: 33173
  hemagglutinin__InfluenzaA__AFR84824

SEQ ID NO: 40184 - RNA, 1701 nt, Artificial Sequence
  hemagglutinin__InfluenzaA__AFR84834
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40185 - RNA, 1701 nt, Artificial Sequence; identical to SEQ ID NO: 38373
  hemagglutinin__InfluenzaA__AFR84844

SEQ ID NO: 40186 - RNA, 1701 nt, Artificial Sequence; identical to SEQ ID NO: 33457
  hemagglutinin__InfluenzaA__AFR84854

SEQ ID NO: 40187 - RNA, 1701 nt, Artificial Sequence; identical to SEQ ID NO: 33173
  hemagglutinin__InfluenzaA__AFR84864

SEQ ID NO: 40188 - RNA, 1701 nt, Artificial Sequence; identical to SEQ ID NO: 38387
  hemagglutinin__InfluenzaA__AFR84874

SEQ ID NO: 40189 - RNA, 1701 nt, Artificial Sequence; identical to SEQ ID NO: 33168
  hemagglutinin__InfluenzaA__AFR84893

SEQ ID NO: 40190 - RNA, 1701 nt, Artificial Sequence; identical to SEQ ID NO: 33168
  hemagglutinin__InfluenzaA__AFR84903

SEQ ID NO: 40191 - RNA, 1701 nt, Artificial Sequence; identical to SEQ ID NO: 33168
  hemagglutinin__InfluenzaA__AFR84913

SEQ ID NO: 40192 - RNA, 1701 nt, Artificial Sequence; identical to SEQ ID NO: 33168
  hemagglutinin__InfluenzaA__AFR84923

SEQ ID NO: 40193 - RNA, 1689 nt, Artificial Sequence
  hemagglutinin__InfluenzaA__AFV53205
auggccaucauuuaucucauacuccuguucgcaacagugaggggggaccagauaugcauuggauaccaugccaauaauuccacagaaaaggucgacacaauucuagagcggaaugucacugugacucaugccaaggacauccuugagaagacccacaacggaaaacuaugcaaacuaaacggaaucccuccacuugaacuaggggacuguagcauugccggauggcuccuuggaaauccagaaugugauaggcuucuaagggugccagaaugguccuauauaauggagaaagaaaacccaagauacaguuuguguuacccaggcagcuuaaaugacuaugaagaauugaaacaucuccucagcagcguaagacauuucgagaaaguaaggauucugcccaaagauagauggacacagcauacaacaacuggagauucaaaggccugcgcagugucagguaaaccaucauucuucaggaacauggucuggcugacaaagaaaggaccagauuauccgguugccaaaggaucguauaacaauacgagcggagagcaaaugcuaauaauuuggggagugcaccauccuauugaugaagcagaacaaagagaauuguaccagaaagugggaaccuauguuuccgcaagcacaucaacauugaacaaaaggucaaucccugaaauagcagcaaggccugaagugaauggacuuagaaguagaauggaauucucuuggacccucuuggauguaugggacaccauaaauuuugagagcacugguaaucuaauugcaccagaguauggauucaaaauaucaaaaagagguaguucaggaaucaugaagacagaaggaacacuuggaaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccaaauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugaugaaaucaccaacaagguaaauucugugauugaaaagaugaacacccaauuugaagcuguugggaaagaauucaauaauuuagagaaaagacuggagaacuugaacaaaaagauggaagauggguuccuagauguguggacauacaaugcugagcuucuaguucugauggaaaaugagaggacacuugacuuccaugauucuaauguaaaaaaccuguaugaaaaagucagaaugcagcugagagacaacgucaaagaacuaggaaauggauguuuugaauuuuaucacaaaugugacgaugaaugcauaaauagugugaaaaacggaacguaugauuaucccaaguaugaagaagaaucuaaacuaaagagaaaugaaaucaaagggguaaaauugagcagcauggggguuuaccaaauucuugccauuuaugcuacaguugcagguucucugucacuggcaaucaugauggcugggaucucuuucuggaugugcuccaacgggucucugcagugcagaaucugcauauga

SEQ ID NO: 40194 - RNA, 1689 nt, Artificial Sequence
  hemagglutinin__InfluenzaA__AFV53216
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaacgauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacagagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagacauagcaacaaggccuaaagugaauggacaaggagguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugggaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugagaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggauuuaucaaauccuugccauuuaugcuacaguagcagguucucugucacuggcaaucaugauggcugggaucucuuucuggaugugcuccaacgggucucugcagugcaggaucugcauauga

SEQ ID NO: 40195 - RNA, 1689 nt, Artificial Sequence
  hemagglutinin__InfluenzaA__AFV53227
augaucaucauuuaucucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaaucccuccacuugaacuaggggauuguagcauugccggauggcuccuuggaaauccagaaugugauaggcuucuaagggugccagaaugguccuauauaauggagaaagaaaacccgagauacaguuuguguuauccaggcagcuucaaugacuaugaagaauugaaacaucuccuaaguagcguaaaacacuucgagaaaguaaagauucugccaaaagauggauggacacagcauaagacagauggagguucaaaggccugcgcagugucagguaaagcaucauucuucaggaacauggucuggcugacaaaggaaggaccaaauuaucagguugccaaaagaucguacaacaauacgagcggagagcaaaugcuaauaauuuggggagugcaccauccuaaggaugaggcggaacaaauagcauuguaccagaaagugggaaccuauguuuccgcaagcacaucaacauugaacaaaaggucaaccccagaaauagcagcaaggccugaagugaauggacuagggaguagaauggaauucucuuggacccucuuggaugugugggacaccauaaauuuugagagcacugguaaucuaguugcaccagaguauggauucaaaauaucgaaaagagguagcucagggaucaugaagacagaaggaacacuugggaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaaaggcauuugacagaaucaccaacaagguaaauucugugauugaaaagaugaacauccaauuugaagcuguugggaaagaauucaguaacuuagagaaaagacuggaaaacuugaacaaaaagauggaagacggguuucuagauguguggacauacaaugcugagcuucuaguucugauggaaaaugagaggacacuugacuuucaugauucuaaugucaagaaccuguaugauaaagucagaaugcagcugagagacaaugucaaagaacuaggaaauggauguuuugaauuuuaucauaaaugugacgaugaaugcaugaauagugugaaaaaugggacauaugauuaucccaaguaugaagaagaaucuaagcuaaagagaaaugaaaucaaagggguaaaauugagcagcauggggguuuaccaaauucuugccauuuaugcuacaguugcagguucucugucauuggcaaucaugauagcugggaucucuuucuggauguguuccaacgggucucugcagugcagagucugcauauga

SEQ ID NO: 40196 - RNA, 1689 nt, Artificial Sequence
  hemagglutinin__InfluenzaA__AFV53238
auggccaucauuuaucucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaaucccuccacuugaacuaggggacuguagcauugccggauggcuccuuggaaauccagaaugugauaggcuucuaagggugccagaaugguccuauauaauggagaaagaaaacccgagauacaguuuguguuacccaggcagcuucaaugacuaugaagaauugaaacaucuccucagcagcguaaaacauuucgagaaaguaaagauuuugcccaaagauagauggacacagcauacaacaacuggagguucaauggccugcgcggugucagguaaaccaucauucuucaggaacauggucuggcugacaacgaaaggaccaaauuauccgguugcccaaggaucguacaacaauacgagcggagaacaaaugcuaauaauuuggggagugcaccauccuaaugaugaggcagaacaaagagcauuguaccagaaagugggaaccuauguuuccgcaagcacaucaacauuguacaaaaggucaaucccagaaauagcagcaaggccuaaagugaauggacuaggaaguagaauggaauucucuuggacccucuuggauaugugggacaccauaaauuuugagagcacugguaaucuaguugcaccagaguauggguuuaaaauaucgaaaagagguaguucagggaucaugaagacagaaggaacacuugagaacugugaaaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagaaaagacuggagaacuugaacaaaaagauggaagacggguuucuagauguguggacauacaaugcagagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugacaaugaaugcauggauagugugaaaaacgggacauaugauuaucccaaguaugaagaagaaucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcagaaucugcauauga

SEQ ID NO: 40197 - RNA, 1689 nt, Artificial Sequence
  hemagglutinin__InfluenzaA__AFV53249
auggccaucauuuaucucauacuccuguucgcaacagugaggggggaccagauaugcauuggauaccaugccaauaauuccacagaaacggucgacacaauucuagagcggaaugucacugugacucaugccaaggacauccuugagaagacccacaacggaaagcuaugcaaacuaaacggaaucccuccacuugaacuaggggacuguagcauugcaggauggcuccuuggaaauccagaaugugauaggcuucuaagggugccagaaugguccuauauaauggagaaagaaaauccaagauacaguuuguguuacccaggcagcuuaaaugacuaugaagaauugaaacaucuccucagcagcguaaaacauuucgagaaaguaaggauucugcccaaagauagauggacaaaucauacaacaacuggagguucaaaggccugcgcagugucaggugaaccaucauucuucaggaacauggucuggcugacaaagaaaggaccaaauuauccgguugccaaaggaucuuauaacaauacgagcggagagcaaaugcuaauaauuuggggagugcaccauccuaaugaugaggcagaacaaagagcauuguaccagaaagugggaaccuauguuuccgcaagcacaucaacauuguacaaaagaucaaucccugaaauagcagcaaggccuaaagugaauggacuuggaaguagaauggaauucucuuggacccucuugaauguaugggacaccauaaauuuugagagcacugguaauuuaguugcaccagaguauggauucaaaauaucaaaaagagguagaucagggaucaugaaaacagaaggaacacuugggaacugugagaccaaaugccaaacuccuuugggagcaauaaauacaacacuaccuuuucacaauguccacccacugacaauaggugaaugccccaaauauguaaaaucggagaaauugguccuagcaacaggacuaaggaauguuccccaaauugaaucaagaggauuguuuggggcaauagcuggcuuuauagaaggaggauggcaaggaaugguugaugguugguauggauaccaucacagcaaugaccagggaucaggguaugcagcagacaaagaauccacucaaaaggcauuugauggaaucaccaacaaggugaauucugugauugaaaaaaugaacacccaauuugaagccguugggaaagaauucaauaauuuagagaaaagacuggagaacuugaacaaaaagauggaagacggguuccuagauguguggacauacaaugcugagcuucuaguucugauggaaaaugagaggacacuugacuuccaugauucuaauguaaaaaaccuguaugaaaaagucagaaugcagcugagagacaacgucaaagaacuaggaaauggauguuuugaauuuuaucacaaaugugacgaugaaugcaugaauagugugaaaaacggaacguaugauuaucccaaguaugaagaagaaucuaaacuaaagagaaaugaaaucaaagggguaaaauugagcagcauggggguuuaccaaauucuugccauuuaugcuacaguugcagguucucugucacuggcaaucaugguggcugggaucucuuucuggaugugcuccaacgggucucugcagugcagaaucugcauauga

SEQ ID NO: 40198 - RNA, 1698 nt, Artificial Sequence
  hemagglutinin__InfluenzaA__AFV53260
augaaagcaaaacuacugauccuguuaugugcacuuuccgcuacagaugcagacacaauauguauaggcuaccaugcgaacaacucaaccgacacuguugacacaguacucgagaagaaugugacagugacacacucuguaaaccuacucgaagacagccacaaugggaaauuaugcagauuaaaaggaaaagccccacuacaauuggggaacuguaacauugccggaugggucuuaggaaacccagaaugcgaaucauugcucuccaauagaucaugguccuacauugcagaaacaccaaacucugagaaugggacaugcuacccaggggauuucgccgacuaugaggaacugagggagcaauugagcucaguaucaucauucgagagauucgaaauauuccccaaggaaagaucauggcccaaccacacaaccagaggagugacggcagcaugcccccaugcgaugaaaagcaguuuuuacaaaaauuuggucuggcugacggaggcaaauggcucauacccaaaucugagcagguccuaugugaacaaucaagagaaagaaguccuugugcuauggggaguucaucacccgucuaacauagaggaucaaaggacccucuaucggaaagauaaugcuuaugucucuguagugucuucaaauuauaacaggagauucaccccagaaauagcaaaaaggcccaaaguaagaggucaaucagggagaauuaacuauuacuggacuuugcuagaacccggagacacaauaauauuugaggcaacugggaaucuaauagcaccaugguaugcuuucgcacugaguagaggcccuggaucagggaucaucaccucaaacgcaccacuggaugaaugugacacgaagugucaaacaccccagggagcuauaaacaguagucucccuuuucagaauauacacccugucacaauaggagagugcccaaaauacgucaggaguacaaaauugaggaugguuacaggacuaaggaacaucccauccuuucaauccaggggucuguuuggagccauugccgguuucauugaagggggauggacugggaugauggauggaugguaugguuaccaucaucagaacgaacagggaucuggcuaugcugcggaucaaaaaagcacacaaaaugccauuaacgggauuacaaauaaggugaacucuguuaucgagaaaaugaacacucaauucacagcuguggguaaagaauucaacaaauuagaaaaaagaauggaaaacuuaaauaaaaagguugaugauggauuucuggauauuuggacauauaaugcagaauuguugguucuacuggaaaaugaaaggacuuuggauuuucaugacucaaaugugaagaaucuguaugagaaaguaaaaaaccaauuaaggaauaaugcaaaggaacuaggaaauggguguuuugaguucuaccacaagugugacaaugaaugcauggaaaguguaaaaaauggaacuuaugacuacccaaaauauucagaggaaucaaaauuaaacagggaaaagauugauggagugaaauuggaaucaaugggggucuaucggauucuggcgaucuacucaacugucgccaguucacuagugcuucuggucucccugggggcaaucagcuucuggauguguucuaaugggucuuuacagugcagaauaugcaucuga

SEQ ID NO: 40199 - RNA, 1689 nt, Artificial Sequence
  hemagglutinin__InfluenzaA__AFV53271
auggccaucacuuaucucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaaucccuccacuugagcuaggggacuguagcauugccggauggcuccuuggaaauccagaaugugauagguuucuaagggugccagaaugguccuauauaauggagaaagaaaacccgagauacaguuuguguuacccaggcagcuucaaugacuaugaagaauugaaacaucuccucagcagcguaaaacauuucgagaaaguaaagauucugcccaaagauggauggacacagcauacaacaacuggagguucaauggccugcgcggugucagguaaaccaucauucuucaggaacauggucuggcugacagagaaaggacaaaauuauccaguugccaaaggaucguacaacaauacgagcggagaacaaaugcuaauaauuuggggagugcaccauccuaaugaugaggcagaacaaagagcauuguaccagaaagugggaaccuauguuuccgcaagcacaucaacauugaacaaaaggucaaccccagaaauagcagcaaggccuaaagugaauggacuaggaaguagaauggaauucucuuggacccucuuggauaugugggacaccauaaauuuugagagcacugguaaucuaguugcaccagaguauggauucaaaauaucgaaaagagguaguucagggaucaugaagacagaaggaacacuugagaacugugaaaccaaaugccaaacuccuuugggagcaauaaauacaacacuaccuuuucacaauguccacccacugacaauaggugaaugccccaaauauguaaaaucggagaaauuggucuuagcaacaggacuaaggaauauuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacucaauuugaagcuguugggaaagaauucaguaacuuagagaaaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugacaaugaaugcauggauagugugaaaaacgggacguaugauuaucccaaguaugaagaagaaucuaaacuaaauagaaaugaaaucaaagggguaaaguugagcagcauggggguuuaucagauccuugccauuuaugcuacaguggcagguucucugucacuggcaaucaugauggcugggaucucuuucuggaugugcuccaacgggucucugcagugcagaaucugcauauga

SEQ ID NO: 40200 - RNA, 1689 nt, Artificial Sequence
  hemagglutinin__InfluenzaA__AFV53282
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaacaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagaaauagcaacaaggccuaaagugaauggacuaggaaguagaauggaauucucuuggacccucuuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuuaggagcaauaaauacaacauugccuuuucacaauguccacccacugacaauaggugagugccccaaauauguaaaauuggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauguaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 40201 - RNA, 1689 nt, Artificial Sequence
  hemagglutinin__InfluenzaA__AFV53293
auggccaucauuuaucucauacuccuguucacaucagugaggggggaccagauaugcauuggauaccaugccaauaauuccacagaaaaggucgacacaauucuagagcggaaugucacugugacucaugccaagaacauccuugagaagacccauaacggaaagcuaugcaaacuaaacggaaucccuccacuugaacuaggggacuguagcauugccggauggcuccuuggaaauccagaaugugauaggcuucuaagggugccagaaugguccuauauaauggagaaagaaaacccgaaauacaguuuguguuacccaggcagcuucaaugacuaugaagaauugaaacaucuccucagcagcguaaaacauuucgagaaaguaaagauucugcccaaagauggauggacacagcauacaacaaauggagguucaagggccugcgcggugucagguaacccaucauucuucaggaacauggucuggcugacaaagaaaggaccaaauuauccgguugccaaaggaucguacaacaauacgagcggagaacaaaugcuaauaauuuggggagugcaccauccuaaugaugaggcagaacaaagagcauuguaccaggaagugggaaccuauguuucugcaagcacaucaacauugaacaaaaggucaaccccagaaauagcagcaaggccuaaagugaauggacuaggaaguagaauggaauucucuuggacccucuuggauaugugggacaccauaaauuuugagagcacugguaaucuaguugcaccagaguauggauucaaaauaucgaaaagagguaguucaggggucaugaagacagaaggaacacuugagaacugugagaccaaaugccaaacuccuuugggagcaauaaauacaacacuaccuuuucacaauguccacccacugacaauaggugaaugccccaaauauguaaaaucagagaaauuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucagcaacuuagagaaaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugacgaugaaugcauggauagugugaaaaacgggacauaugauuaucccaaguaugaagaagaaucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcagaaucugcauauga

SEQ ID NO: 40202 - RNA, 1689 nt, Artificial Sequence
  hemagglutinin__InfluenzaA__AFV53304
auggccaucauuuaucucauucuccuguucacagcagugagaggggaccagauaugcauuggauaccaugccaauaauuccacagagaaggucgacacaauucuagagcagaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaagaaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccaaacauagcaacaaggccuaaagugaauggacuaggaaguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcagaaucugcauauga

SEQ ID NO: 40203 - RNA, 1689 nt, Artificial Sequence
  hemagglutinin__InfluenzaA__AFV53314
auggccaucauuuaucucauucuccuguucacagcagugagaggggacaagauaugcauuggauaccaugccaauaauuccacagagacggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagaaacgguuuguguuauccaggcaacuucaaugauuaugaagaauugaaacaucuccucagcagcgugaaacauuucgagaaaguaaagauucugcccaaagauagauggacacagcauacaacaacuggagguucacaggccugcgcggugucugguaauccaucauucuucaggaacauggucuggcugacagagaaagaaucaaauuauccgguugccaaaggaucguacaacaauacaagcggagaacaaaugcuaauaauuuggggggugcaccaucccauugaugagacagaacaaagaacauuguaccagaaugugggaaccuauguuuccguaggcacaucaacauugaacaaaaggucaaccccagaaauagcaaaaaggccuaaagugaauggacuaggaaguagaauggaauucucuuggacccucuuggauaugugggacaccauaacuuuugagaguacugguaaucuaauugcaccagaguauggauucaaaauaucgaaaagagguaguucugggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaaugcugugauugaaaagauaaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 40204 - RNA, 1689 nt, Artificial Sequence
  hemagglutinin__InfluenzaA__AFV53325
auggccaucauuuaucucauucuccuguucacagcagugagaggggaccaaauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucaaauuauacgguugccaaaggaucguacaacaauacaagcggagaacaaaugcuaauaauuuggggggugcaccaucccaaugaugagacagaacaaagaacauuguaccagaaugugggaaccuauguuuccguaagcacaucaacauugaacaaaaggucaaccccagaaauagcaacaaggccuaaagugaauggacuaggaaguagaauggaauucucuuggacccucuuggauaugugggacaccauaaauuuugagaguacugguaaucuaauugcuccagaguauggauucaaaauaucgaaaagagguaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugagugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 40205 - RNA, 1689 nt, Artificial Sequence
  hemagglutinin__InfluenzaA__AFV53336
auggccaucauuuaucucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaauuccuccacuugaacuaggggauuguagcauugccggauggcuccuuggaaauccagaaugugauaggcuucuaagggugccagaaugguccuauauaauggagaaagaaaacccgagauacaguuuguguuauccaggcagcuucaaugacuaugaagaauugaaacaucuccucaguagcguaaaacaccucgagaaaguaaagauucugccaaaagauggauggacacagcaugagacagauggagguucaaaggccugcgcagugucagguaaaccaucauucuucaggaacauggucuggcugacaaagaaaggaccuaauuauccgguugccaaaagaucguacaacaauacgagcggagagcaaaugcuaauaauuuggggagugcaccauccuaaugaugaggcagaacaaagagcauuguaccagaaagugggaaccuauguuuccgcaagcacaucaacauugaacaaaaggucaaccccagaaauagcagcaaggccugaagugaguggacuaggaaguagaauggaauucucuuggacccucuuggaugugugggacaccauaaguuuugagagcacugguaaucuaguugcaccagaguauggauucaaaauaucgaaaagagguaguucagggaucaugaagacagaaggaacacuugggaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaaaggcauuugacagaaucaccaacaagguaaauucugugauugaaaagaugaacacccaauuugaagcuguugggaaagaauucaguaacuuagagaaaagacuggaaaacuugaacaaaaagauggaagacggguuucuagauguguggacauacaaugcugagcuucuaguucugauggaaaaugagaggauacuugacuuucaugauucuaaugucaagaaccuguaugauaaagucagaaugcagcugagagacaacgucaaagaacuaggaaauggauguuuugaauuuuaucauaaaugugacgaugaaugcaugaauagugugaaaaaugggacguaugauuaucccaaguaugaagaagaaucuaaacuaaagagaaaugaaaucaaaggggugaaauugagcagcauggggguuuaccaaauucuugccauuuaugcuacaguugcagguucucugucacuggcaaucaugauagcugggaucucuuucuggaugugcuccaacgggucucugcagugcagaaucugcauauga

SEQ ID NO: 40206 - RNA, 1701 nt, Artificial Sequence
  hemagglutinin__InfluenzaA__AFV68720
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguucuucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucugauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcugugaucccgaauaucggaucuagacccagaauaaggaauaucccuagcagaauaagcaucuauuggacaauaguaaaaccgggagacauacuuuugauuaacagcacaggaaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagaaaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggaaaaccaacauacaauugaucuaacugacucagaaaugaacaaacuguuugaaaaaacaaagaagcaacugagggaaaaugcugaggauaugggcaauggcuguuucaaaauauaccacaaaugugacaaugccugcauaggaucaaucagaaauggaacuuauaaccacgauguauacagagaugaagcauuaaacaaccgguuccagaucaagggaguugagcugaaaucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40207 - RNA, 1701 nt, Artificial Sequence
  hemagglutinin__InfluenzaA__AFX96347
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccaaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40208 - RNA, 1701 nt, Artificial Sequence
  hemagglutinin__InfluenzaA__AFX96359
augaaggcaauacuaguaguucugcuguauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40209 - RNA, 1701 nt, Artificial Sequence
  hemagglutinin__InfluenzaA__AFX96366
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauagagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaacuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaggaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40210 - RNA, 1701 nt, Artificial Sequence
  hemagglutinin__InfluenzaA__AFX96383
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucuacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40211 - RNA, 1701 nt, Artificial Sequence; identical to SEQ ID NO: 40207
  hemagglutinin__InfluenzaA__AFX96398

SEQ ID NO: 40212 - RNA, 1701 nt, Artificial Sequence; identical to SEQ ID NO: 40207
  hemagglutinin__InfluenzaA__AFX96408

SEQ ID NO: 40213 - RNA, 1701 nt, Artificial Sequence; identical to SEQ ID NO: 40207
  hemagglutinin__InfluenzaA__AFX96418

SEQ ID NO: 40214 - RNA, 1701 nt, Artificial Sequence; identical to SEQ ID NO: 40207
  hemagglutinin__InfluenzaA__AFX96428

SEQ ID NO: 40215 - RNA, 1701 nt, Artificial Sequence; identical to SEQ ID NO: 40207
  hemagglutinin__InfluenzaA__AFX96438

SEQ ID NO: 40216 - RNA, 1701 nt, Artificial Sequence; identical to SEQ ID NO: 40207
  hemagglutinin__InfluenzaA__AFX96448

SEQ ID NO: 40217 - RNA, 1701 nt, Artificial Sequence; identical to SEQ ID NO: 40207
  hemagglutinin__InfluenzaA__AFX96458

SEQ ID NO: 40218 - RNA, 1701 nt, Artificial Sequence; identical to SEQ ID NO: 33206
  hemagglutinin__InfluenzaA__AFX96468

SEQ ID NO: 40219 - RNA, 1701 nt, Artificial Sequence; identical to SEQ ID NO: 33173
  hemagglutinin__InfluenzaA__AFX96478

SEQ ID NO: 40220 - RNA, 1701 nt, Artificial Sequence; identical to SEQ ID NO: 33206
  hemagglutinin__InfluenzaA__AFX96488

SEQ ID NO: 40221 - RNA, 1701 nt, Artificial Sequence
  hemagglutinin__InfluenzaA__AFX96498
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagaucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40222 - RNA, 1701 nt, Artificial Sequence
  hemagglutinin__InfluenzaA__AFX96508
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugcuaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40223 - RNA, 1701 nt, Artificial Sequence; identical to SEQ ID NO: 34673
  hemagglutinin__InfluenzaA__AFX96518

SEQ ID NO: 40224 - RNA, 1701 nt, Artificial Sequence; identical to SEQ ID NO: 33206
  hemagglutinin__InfluenzaA__AFX96528

SEQ ID NO: 40225 - RNA, 1701 nt, Artificial Sequence; identical to SEQ ID NO: 34673
  hemagglutinin__InfluenzaA__AFX96538

SEQ ID NO: 40226 - RNA, 1701 nt, Artificial Sequence
  hemagglutinin__InfluenzaA__AFX96548
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40227 - RNA, 1701 nt, Artificial Sequence; identical to SEQ ID NO: 33206
  hemagglutinin__InfluenzaA__AFX96558

SEQ ID NO: 40228 - RNA, 1701 nt, Artificial Sequence; identical to SEQ ID NO: 34517
  hemagglutinin__InfluenzaA__AFX96568

SEQ ID NO: 40229 - RNA, 1701 nt, Artificial Sequence
  hemagglutinin__InfluenzaA__AFX96578
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaauucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40230 - RNA, 1701 nt, Artificial Sequence; identical to SEQ ID NO: 33206
  hemagglutinin__InfluenzaA__AFX96588

SEQ ID NO: 40231 - RNA, 1701 nt, Artificial Sequence; identical to SEQ ID NO: 33206
  hemagglutinin__InfluenzaA__AFX96598

SEQ ID NO: 40232 - RNA, 1701 nt, Artificial Sequence
  hemagglutinin__InfluenzaA__AFX96608
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacucucgccaguucauuggugcugguagucucccugggggcaaucaguuucuggaugugcucuaaugggucucuacaguguagaauauguauuuaa

SEQ ID NO: 40233 - RNA, 1701 nt, Artificial Sequence
  hemagglutinin__InfluenzaA__AFX96618
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40234 - RNA, 1701 nt, Artificial Sequence
  hemagglutinin__InfluenzaA__AFX96628
augaaggcaauacuaguaguucugcuauauacauuugcaaccgcaaaugcagacacauuaugcauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccauccacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40235 - RNA, 1701 nt, Artificial Sequence
  hemagglutinin__InfluenzaA__AFX96638
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaguauggcuaguuaaaaaaggaaauucauacccaaagcucagcaaauccuacauuaaugauaaagggaaagaaguccucgugcuauggggcauucaccauccaucuacuagugcugaccaacaaagucucuaccagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaaugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagaaaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcuguuuugaauucuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40236 - RNA, 1701 nt, Artificial Sequence
  hemagglutinin__InfluenzaA__AFX96648
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguucucguucuauggggcauucaccauccaucuacuagugcugaccaacaaagucucuaccagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40237 - RNA, 1701 nt, Artificial Sequence; identical to SEQ ID NO: 34517
  hemagglutinin__InfluenzaA__AFX96658

SEQ ID NO: 40238 - RNA, 1701 nt, Artificial Sequence
  hemagglutinin__InfluenzaA__AFX96668
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguucaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaguuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40239 - RNA, 1701 nt, Artificial Sequence
  hemagglutinin__InfluenzaA__AFX96678
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40240 - RNA, 1701 nt, Artificial Sequence
  hemagglutinin__InfluenzaA__AFX96688
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagauugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcuacuggaaaucuagugguaccgagauacgcauucgcaauggaaagaaaugauggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40241 - RNA, 1701 nt, Artificial Sequence
  hemagglutinin__InfluenzaA__AFX96698
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucauggucauacauuguggaaacaucuaguucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggguugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40242 - RNA, 1701 nt, Artificial Sequence
  hemagglutinin__InfluenzaA__AFX96718
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagaucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaagccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40243 - RNA, 1701 nt, Artificial Sequence; identical to SEQ ID NO: 40242
  hemagglutinin__InfluenzaA__AFX96728

SEQ ID NO: 40244 - RNA, 1701 nt, Artificial Sequence; identical to SEQ ID NO: 38716
  hemagglutinin__InfluenzaA__AFX96738

SEQ ID NO: 40245 - RNA, 1701 nt, Artificial Sequence
  hemagglutinin__InfluenzaA__AFX96748
augaaggcaauacuaguaguucugcuauauacaauugcaaccgcaaaugcagacacauuauguauagguuaucaugcgaacaauucaacagacacuguagacacaguaauagaaaagaauguaacaguaacacacucuguuaaccuuuuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagaacaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40246 - RNA, 1701 nt, Artificial Sequence
  hemagglutinin__InfluenzaA__AFX96758
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40247 - RNA, 1701 nt, Artificial Sequence
  hemagglutinin__InfluenzaA__AFX96768
augaaggcaauacuaguaguucugcuauauacauuugcaaccgcaaaugcagacacauuauguauagguuaucaugcaaacaauucaacggacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaucucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacgugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaagauuuaccagauuuuggcgaucuauucaacugucgccaguucauuggugcugguagucucccugggggcaaucaguuucuggaugugcucuaaugggucucuacaguguagaauauguauuuaa

SEQ ID NO: 40248 - RNA, 1701 nt, Artificial Sequence
  hemagglutinin__InfluenzaA__AFX96778
augaaggcaauacuaguaauucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauucccaaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40249 - RNA, 1701 nt, Artificial Sequence
  hemagglutinin__InfluenzaA__AFX96788
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaaaaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucugucauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaauuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40250 - RNA, 1701 nt, Artificial Sequence
  hemagglutinin__InfluenzaA__AFX96798
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccggagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaaguuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaaaaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaauuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40251 - RNA, 1701 nt, Artificial Sequence
  hemagglutinin__InfluenzaA__AFX96808
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguucccaaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauaugucaaaagcacaaaauugagacuggccacaggauugagaaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40252 - RNA, 1701 nt, Artificial Sequence
  hemagglutinin__InfluenzaA__AFX96818
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaccaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40253 - RNA, 1701 nt, Artificial Sequence
  hemagglutinin__InfluenzaA__AFX96828
augaaggcaauacuaguaguucugcuauauacauuugcaaccgcaaaugcagacacauuauguauagguuaucaugcgaacaauucaacagacacuguagacacaguacuagaaaagaauguaacaguaacgcacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcgggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaaaaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaauuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40254 - RNA, 1701 nt, Artificial Sequence
  hemagglutinin__InfluenzaA__AFX96838
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauucccaaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccaaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacucuugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguauugguagucucccugggggcaaucaguuucuggaugugcucuaaugggucucuacaguguagaauauguauuuaa

SEQ ID NO: 40255 - RNA, 1701 nt, Artificial Sequence
  hemagglutinin__InfluenzaA__AFX96856
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguacucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaccagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaggcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40256 - RNA, 1701 nt, Artificial Sequence
  hemagglutinin__InfluenzaA__AFX96904
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguucaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuucuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40257 - RNA, 1701 nt, Artificial Sequence
  hemagglutinin__InfluenzaA__AFX96914
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40258 - RNA, 1701 nt, Artificial Sequence
  hemagglutinin__InfluenzaA__AFX96924
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagagguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaggaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40259 - RNA, 1701 nt, Artificial Sequence
  hemagglutinin__InfluenzaA__AFX96934
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuauugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40260 - RNA, 1701 nt, Artificial Sequence
  hemagglutinin__InfluenzaA__AFY24097
augaaggcaauacuaguaguucugcuauauacauuugcaaccgcaaaugcagacacauuauguauagguuaucaugcggacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguuuaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaguguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaaccaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40261 - RNA, 1701 nt, Artificial Sequence
  hemagglutinin__InfluenzaA__AFY24162
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccaggguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccguuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40262 - RNA, 1701 nt, Artificial Sequence
  hemagglutinin__InfluenzaA__AFY24195
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccaggauaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40263 - RNA, 1701 nt, Artificial Sequence
  hemagglutinin__InfluenzaA__AFY24217
augaagacuaucauugcuuugagcuacauucuaugucugguuuuugcucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauccgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaacagguuaaucgggaaaacaaacgagaaauuccaucagauugaaaaagaauucucagaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagagucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40264 - RNA, 1701 nt, Artificial Sequence
  hemagglutinin__InfluenzaA__AGB08294
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguggccccauugcauuuggguaaauguaacauugcuggcuggauccugggaaauccagagugugaaucacucuccacagcaagcucaugguccuacaucguggaaacaucuaguucagacaauggaacgugcuacccaggagauuucaucaauuaugaggagcuaagagagcaauugagcucagugucaucauuugaaagguuugagauauuccccaagacaaguucauggcccaaucaugacucgaacaaagguguaacggcagcauguccucaagcuggagcaaaaagcuucuacaaaaauuuaauauggcuaguuaaaaaaggaaauucauacccaaagcucaucaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacauuaguagagccgggagacaaaauaacauucgaagcaacuggaaaucuauugguaccaagauaugcauucguaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugcgcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaacuuuggacuaucacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaagauacucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40265 - RNA, 1701 nt, Artificial Sequence
  hemagglutinin__InfluenzaA__AGB08295
augaaggcaauacuaguaguucugcuauauacauuugcaaccgcaaaugcagacacauuauguauagguuaucaugcgaacaauucaacagacacuguagacacaguaauagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuauccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaaaggaaagaaguccucgugcuguggggcauucaccauccaucuacuacugcugaccaacaaagucucuaucagaaugcagaugcauauguuuuuguggggacaucaagauacagcaagaaauucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaacugcuggaucugguauuaucauuucagauacaccaguccacgauugcaauacaacuugucagacacccaagggugcuauaaacaccagccucccauuucagaauauacauccgaucacaauuggaaaauguccaaaguauguaaaaagcacaaaauugagacuggccacaggauugaggaauaucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauugggaacggcugcuuugaauuuuaccacaaaugcgauaacacgugcauggaaagugucaagaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40266 - RNA, 1701 nt, Artificial Sequence
  hemagglutinin__InfluenzaA__AGB08296
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaauucaagccggaaauagcaauaagacccaaggugaggggucaagaagggagaaugaacuauuacuggacacuaguagagccgggagacaaaauaacauucgaagcaacuggaaaucuagugguaccgagauaugcauucgcaauggaaagaacugcuggaucugguauuaucauuucagauacaccaguccacgauugcaauacaacuugucagacacccaagggugcuauaaacaccagccucccauuucagaauauacauccgaucacaauuggaaaauguccaaaguauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauugggaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40267 - RNA, 1701 nt, Artificial Sequence
  hemagglutinin__InfluenzaA__AGB08297
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcgaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaauucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaacugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuaggggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauugggaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 40268 - RNA, 1701 nt, Artificial Sequence
  hemagglutinin__InfluenzaA__AGB08298
augaaggcaauacuaguaguucuucuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggauagccccauugcauuuggguaaauguaacauugcuggcuggaucuugggaaauccagagugugaaucacucuccacagcaagcucgugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaggcucagcaaauccuacauuaaugauaaagggaaagaaguccucgugcuguggggcauucaccauccaucuacuacugcugaccaacaaagucucuaucagaaugcagaugcauauguuuuuguagggacaucaagauacagcaagaaauucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggagagaacugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaacuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauugggaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40269 - RNA, 1701 nt, Artificial Sequence
  hemagglutinin__InfluenzaA__AGB08301
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaguaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaaugggacuuaugaucacaauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40270 - RNA, 1701 nt, Artificial Sequence
  hemagglutinin__InfluenzaA__AGB08343
augaagacuaucauugcuuugagcuacauuuucugucugguucucgcccaagaccuuccaggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcaacaauccucaucgaauccuugauggaauaaacugcacacugauugaugcucuauugggggacccucauugugauggcuuucaaaauaagaaaugggaccuuuuuguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcuaugcuugcaaaaggggaccugauaacgguuuuuucaguagacugaacugguuguacaaaucagaaagcacauauccagugcugaacgugacuaugccaaacaaugacaauuuugacaaacuauacauuugggggguucaccacccgagcacggacaaagaacaaaccaaccuauauguucaagcaucagggagagucacagucuccaccaagagaagccagcaaacuauaaucccgaaugucgggucuagacccuggguaaggggucugucuaguagaauaagcaucuauuggacaauaguuaaaccgggugacauacugguaauuaauaguaaugggaaccuaauugcuccucgggguuacuucaaaauacgcaaugggaaaagcucaauaaugaggucagaugcaccuauuggcaccugcaguucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuaggggcauauucggugcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauagaguaaucgagaaaacgaacgagaaauuccaucaaaucgaaaaggaauucucagaaguagaagggagaauucaggaccucgagaaauacguugaagacacuaaaauagaucucuggucuuacaaugcagagcuucuugucgcucuggagaaccaacauacaauugaucugacugacucggaaaugaacaagcuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 40271 - RNA, 1701 nt, Artificial Sequence
  hemagglutinin__InfluenzaA__AGB08362
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauaaacugcacacugauagaugcucuauugggggacccucauugugauguuuuucaagaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggaaaaucaacauacaauugaccugacugacucggaaaugaacaagcuguuugauaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 40272 - RNA, 1701 nt, Artificial Sequence
  hemagglutinin__InfluenzaA__AGB12986
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuuuuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacaauaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40273 - RNA, 1701 nt, Artificial Sequence
  hemagglutinin__InfluenzaA__AGB13006
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguagcauugccggcuggauccugggaaauccagaaugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuugauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguacacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 40274 - RNA, 1701 nt, Artificial Sequence
  hemagglutinin__InfluenzaA__AGB13016
augaaggcaauacuaguaguucugcuauauacaauugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaauuggaaaucuagugguaccgagauaugcauucgcaauggaaaaaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaauuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucagcaaggguuuaccagauuuuggcgaucuauucaacugucgccaguucauugguacugguagucucccugggggcaaucaguuucuggaugugcucuaaugggucucuacaguguagaauauguauuuaa

SEQ ID NO: 40275 - RNA, 1701 nt, Artificial Sequence
  hemagglutinin__InfluenzaA__AGB13026
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40276 - RNA, 1701 nt, Artificial Sequence; identical to SEQ ID NO: 37582
  hemagglutinin__InfluenzaA__AGB13036

SEQ ID NO: 40277 - RNA, 1701 nt, Artificial Sequence
  hemagglutinin__InfluenzaA__AGB13048
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauagaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40278 - RNA, 1701 nt, Artificial Sequence
  hemagglutinin__InfluenzaA__AGB13066
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaggcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40279 - RNA, 1701 nt, Artificial Sequence
  hemagglutinin__InfluenzaA__AGB13082
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaaacucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40280 - RNA, 1701 nt, Artificial Sequence; identical to SEQ ID NO: 37582
  hemagglutinin__InfluenzaA__AGB13105

SEQ ID NO: 40281 - RNA, 1701 nt, Artificial Sequence
  hemagglutinin__InfluenzaA__AGB13125
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaagaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40282 - RNA, 1701 nt, Artificial Sequence
  hemagglutinin__InfluenzaA__AGB13130
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 40283 - RNA, 1701 nt, Artificial Sequence
  hemagglutinin__InfluenzaA__AGB13140
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcuuaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40284 - RNA, 1701 nt, Artificial Sequence
  hemagglutinin__InfluenzaA__AGB13159
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccucauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40285 - RNA, 1701 nt, Artificial Sequence
  hemagglutinin__InfluenzaA__AGB13170
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccuugugcuauggggcauucaccauccgucuacuacugcugaccaacaaagucucuaucagaaugcagauacauauguuuuuguggggacaucaagauacagcaagaaguucaagccggaaauagcaauaagacccaaaguaagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaggaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40286 - RNA, 1701 nt, Artificial Sequence
  hemagglutinin__InfluenzaA__AGB13180
augaaggcaauacuaguaguucugcuauauacauuugcaaccgcaaaugcagacacauuauguauagguuaucaugcgaacaauucaacagacaccguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaucaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40287 - RNA, 1701 nt, Artificial Sequence; identical to SEQ ID NO: 40275
  hemagglutinin__InfluenzaA__AGB13190

SEQ ID NO: 40288 - RNA, 1701 nt, Artificial Sequence
  hemagglutinin__InfluenzaA__AGB13200
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucaugcuggaguaaaaagcuucuacaaaaacuuaauauggcuaguuaaaaaaggaaauucauacccaaagcucagcaaauccuacauuaaugauaaagggaaagaaguccucgugcuguggggcauucaccauccaucuacuacuacugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40289 - RNA, 1701 nt, Artificial Sequence
  hemagglutinin__InfluenzaA__AGB13210
augaaggcaacacuaguaguucugcuauauacauuugcaaccgcaaaugcagacacauuauguauagguuaucaugcgaacaauucaacagacacuguagacacaguacuagaaaagaauguaacaguaacacacucuguuaaccuuuuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40290 - RNA, 1701 nt, Artificial Sequence
  hemagglutinin__InfluenzaA__AGB13220
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuauuucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccacuuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuauaugaaaagguaagaaaccaguuaaaaaacaaugccaaggaaauuggaaacggcugcuuugaauuuuaccauaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40291 - RNA, 1701 nt, Artificial Sequence
  hemagglutinin__InfluenzaA__AGB13230
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaaucauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccgccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40292 - RNA, 1701 nt, Artificial Sequence; identical to SEQ ID NO: 40275
  hemagglutinin__InfluenzaA__AGB13240

SEQ ID NO: 40293 - RNA, 1701 nt, Artificial Sequence; identical to SEQ ID NO: 40275
  hemagglutinin__InfluenzaA__AGB13250

SEQ ID NO: 40294 - RNA, 1701 nt, Artificial Sequence
  hemagglutinin__InfluenzaA__AGB13260
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggaucaaaaagcuucuacaaaaauuuaauauggcuaguuaaaaaaggaaauucauacccaaaacucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuggugguaccgagauaugcauucgcaauggaaagaaaugcuggaucugguauuaucauuucagauacaccaguccacgauugcaauacaacuugucagacacccaagggggcuauaaacaccagccuuccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaaguaucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40295 - RNA, 1701 nt, Artificial Sequence
  hemagglutinin__InfluenzaA__AGB13270
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacagugcagaauauguauuuaa

SEQ ID NO: 40296 - RNA, 1701 nt, Artificial Sequence
  hemagglutinin__InfluenzaA__AGB13280
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuuuuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuaaugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugggcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40297 - RNA, 1701 nt, Artificial Sequence
  hemagglutinin__InfluenzaA__AGB13290
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagucaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggauggacagggaugguagauggaugguacgguuaucaccaucaaaaugagcaggggucaggauaugcagccgaccugaagagcacacagaaugccauugacaagauuacuaacaaaguaaauucuguuauugagaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40298 - RNA, 1701 nt, Artificial Sequence; identical to SEQ ID NO: 40282
  hemagglutinin__InfluenzaA__AGB13300

SEQ ID NO: 40299 - RNA, 1701 nt, Artificial Sequence
  hemagglutinin__InfluenzaA__AGB13310
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaguucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40300 - RNA, 1701 nt, Artificial Sequence
  hemagglutinin__InfluenzaA__AGB13320
augaaggcaauacuaguaguucugcuauauacaauugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaaaaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucagcaaggguuuaccagauuuuggcgaucuauucaacugucgccaguucauugguacugguagucucccugggggcaaucaguuucuggaugugcucuaaugggucucuacaguguagaauauguauuuaa

SEQ ID NO: 40301 - RNA, 1701 nt, Artificial Sequence
  hemagglutinin__InfluenzaA__AGB13330
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacaguaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40302 - RNA, 1701 nt, Artificial Sequence
  hemagglutinin__InfluenzaA__AGB13340
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuguuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40303 - RNA, 1701 nt, Artificial Sequence
  hemagglutinin__InfluenzaA__AGB13350
augaaggcaauacuaguaguucugcuauauacauuugcaaccgcaaaugcagacacauuauguauagguuaucaugcgaacaauucaacagaaacuguagacacaguacuagaaaagaauguaacagugacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacaucguggaaacaucuaguucagacaauggaacgugcuacccaggagauuucaucaauuaugaggagcuaagagagcaauugagcucagugucaucauuugaaagguuugagauauuccccaagacaaguucauggcccaaucaugacucgaacaaagguguaacggcagcauguccucaagcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugcgcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40304 - RNA, 1701 nt, Artificial Sequence
  hemagglutinin__InfluenzaA__AGB13360
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagaccuaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacgggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaaauguugguucuauuggaaaaugaaaaaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40305 - RNA, 1701 nt, Artificial Sequence
  hemagglutinin__InfluenzaA__AGB13380
augaaggcaauacuaguaguucugcuauacacauuugcaaccgcaaaagcagacacauuauguauagguuaucaugcgaacaauucaacagacacuguagacacaguacuagaaaagaauguaacaguaacacacucuguuaaccuucuagaagacaagcauaacgggaaacuaugcaagcuaagagggguagccccauugcauuuggguaaauguaacauugcuggcuggaucuugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaauccuggaucugguauuaucauuucagauacaccaguccacgauugcaauacaacuugucagacacccaagggugccauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40306 - RNA, 1701 nt, Artificial Sequence; identical to SEQ ID NO: 36942
  hemagglutinin__InfluenzaA__AGB13390

SEQ ID NO: 40307 - RNA, 1701 nt, Artificial Sequence; identical to SEQ ID NO: 37546
  hemagglutinin__InfluenzaA__AGB13400

SEQ ID NO: 40308 - RNA, 1701 nt, Artificial Sequence; identical to SEQ ID NO: 36942
  hemagglutinin__InfluenzaA__AGB13410

SEQ ID NO: 40309 - RNA, 1701 nt, Artificial Sequence
  hemagglutinin__InfluenzaA__AGB13420
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucgaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40310 - RNA, 1701 nt, Artificial Sequence
  hemagglutinin__InfluenzaA__AGB13430
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaugauuuaccagauuuuggcgaucuauucaacugucgccaguucauugguacugguagucucccugggggcaaucaguuucuggaugugcucuaaugggucucuacaauguagaauauguauuuaa

SEQ ID NO: 40311 - RNA, 1701 nt, Artificial Sequence
  hemagglutinin__InfluenzaA__AGB13440
augaaggcaauacuaguaguucugcuauauacauuugcaacugcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaugauuuaccagauuuuggcgaucuauucaacugucgccaguucguugguacugguagucucccugggggcaaucaguuucuggaugugcucuaaugggucucuacaguguagaauauguauuuaa

SEQ ID NO: 40312 - RNA, 1701 nt, Artificial Sequence; identical to SEQ ID NO: 37531
  hemagglutinin__InfluenzaA__AGB13450

SEQ ID NO: 40313 - RNA, 1701 nt, Artificial Sequence
  hemagglutinin__InfluenzaA__AGB13460
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaauucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40314 - RNA, 1701 nt, Artificial Sequence; identical to SEQ ID NO: 40275
  hemagglutinin__InfluenzaA__AGB13470

SEQ ID NO: 40315 - RNA, 1701 nt, Artificial Sequence
  hemagglutinin__InfluenzaA__AGB13480
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40316 - RNA, 1701 nt, Artificial Sequence
  hemagglutinin__InfluenzaA__AGB13490
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaaguuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggauuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40317 - RNA, 1701 nt, Artificial Sequence
  hemagglutinin__InfluenzaA__AGB13500
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggaugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40318 - RNA, 1701 nt, Artificial Sequence; identical to SEQ ID NO: 37576
  hemagglutinin__InfluenzaA__AGB13520

SEQ ID NO: 40319 - RNA, 1701 nt, Artificial Sequence
  hemagglutinin__InfluenzaA__AGB13530
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccuggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40320 - RNA, 1701 nt, Artificial Sequence
  hemagglutinin__InfluenzaA__AGB13540
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguagcauugcuggcuggauccugggaaauccagaaugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaagaaaggaaauucauacccaaagcucagcaaauccuacauuaaugauaaaggaaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 40321 - RNA, 1701 nt, Artificial Sequence
  hemagglutinin__InfluenzaA__AGB13550
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuuuuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40322 - RNA, 1701 nt, Artificial Sequence
  hemagglutinin__InfluenzaA__AGB13560
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40323 - RNA, 1701 nt, Artificial Sequence
  hemagglutinin__InfluenzaA__AGB13570
augaaggcaauacuaguaguucugcuauauacauuugcaaccgcaaaugcagacacauuaugcauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuacuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 40324 - RNA, 1701 nt, Artificial Sequence
  hemagglutinin__InfluenzaA__AGB13580
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggauggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacaggaaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauugggaacggcugcuuugaauuuuaccacaaaugcaauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 40325 - RNA, 1701 nt, Artificial Sequence
  hemagglutinin__InfluenzaA__AGB13590
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgauuacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguuuuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40326 - RNA, 1701 nt, Artificial Sequence
  hemagglutinin__InfluenzaA__AGB13600
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaucacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40327 - RNA, 1701 nt, Artificial Sequence; identical to SEQ ID NO: 40282
  hemagglutinin__InfluenzaA__AGB13610

SEQ ID NO: 40328 - RNA, 1701 nt, Artificial Sequence; identical to SEQ ID NO: 38871
  hemagglutinin__InfluenzaA__AGB13620

SEQ ID NO: 40329 - RNA, 1701 nt, Artificial Sequence; identical to SEQ ID NO: 38400
  hemagglutinin__InfluenzaA__AGB13630

SEQ ID NO: 40330 - RNA, 1701 nt, Artificial Sequence
  hemagglutinin__InfluenzaA__AGB13640
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaauucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaauaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagaaaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaugauuuaccagauuuuggcgaucuauucaacugucgccaguucauugguacugauagucucccugggggcaaucaguuucuggaugugcucuaaugggucucuacaguguagaauauguauuuaa

SEQ ID NO: 40331 - RNA, 1701 nt, Artificial Sequence
  hemagglutinin__InfluenzaA__AGB13650
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaauucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaauaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagaaaauuuaaauaaaaaaguugaugaugguuuccuggacauuuggacuuacaaugccgaacuguugauucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaugauuuaccagauuuuggcgaucuauucaacugucgccaguucauugguacugauagucucccugggggcaaucaguuucuggaugugcucuaaugggucucuacaguguagaauauguauuuaa

SEQ ID NO: 40332 - RNA, 1701 nt, Artificial Sequence
  hemagglutinin__InfluenzaA__AGB13660
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40333 - RNA, 1701 nt, Artificial Sequence; identical to SEQ ID NO: 40313
  hemagglutinin__InfluenzaA__AGB13721

SEQ ID NO: 40334 - RNA, 1701 nt, Artificial Sequence
  hemagglutinin__InfluenzaA__AGB13731
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgauuacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40335 - RNA, 1701 nt, Artificial Sequence
  hemagglutinin__InfluenzaA__AGB51356
augaaggcaauacuauuagucuuguuauguacauuugcagccacaaaugcagacacacuauguauagguuaucaugcaaauaauucaacugacacuguugauacaguacuagaaaagaauguaacaguaacacacucuguuaaucuucuugaagacagacauaacgggaaacuauguaaacugggggggauagccccauugcacuuggguaaauguaacauugccggauggcuuuugggaaacccagaaugugaauuacuacucacaguaagcucauggucuuacauuguggaaacaucgaacucagacaaugggacauguuacccaggagauuucaucaauuaugaagagcugagagagcaguugagcucagugucaucauuugaaagauucgagauauuccccaagacaaguucguggcccaaucaugaaacaaacagaggugugacggcagcaugcccuuaugcuggagcaaacagcuucuacagaaauuuaauauggcugguggaaaaaggaaauucauacccaaagcucagcaaauccuauguuaacaauaaagggaaggaaguccuugugcuauggggcauucaucauccaccuaccaguacugaucaacaaagucucuaccaaaaugcagaugccuauguuuuuguagggucaucaaaauauaacagaaaguucaagccagaaauagcagcaagacccaaggugagaggucaagcagggaggaugaacuauuacuggacacuaauagaaccuggagacacaauaacauuugaagcaacuggaaaucuagugguaccaagauaugcuuucgcaaugaauagagguucuggaucugguauuauaauuucggaugcaccaguucaugauuguaacacgaagugucaaacacccaagggugccauaaacaccagccucccauuucagaauauacauccagucacaauuggagaauguccaaaauaugucaaaagcacaaaauugagaauggcuacaggacuaaggaauaucccgucuauucaaucuagaggucuguuuggagccauugcugguuuuauugaggggggauggacaggaaugauagauggaugguaugguuaucaccaucagaaugaacagggaucaggauaugcagcggaccaaaggagcacacaaaaugccauugacgggaucacuaacaaaguaaauucuguuauugaaaagaugaacacgcaauucacggcaguggguaaagaauucaaccacuuggaaaaaagaauagagaauuuaaacaaaaagguugaugaugguuuucuggauauuuggacauacaaugcagaacuguugguucuauuggaaaaugaaagaacucuggauuuccacgacucgaauguaaagaaccuguaugagaaaguaagaagccagcuaaggaacaaugccaaagaaauugggaauggcugcuuugaauucuaucacaaaugugaugauacaugcauggagagcgucaaaaaugggacuuaugauuacccaaaguacucagaagaaucaaagcuaaacagagaggagauagauggaguaaaguuggagucaacaagaauuuaccagauuuuggcgaucuauucaacugucgccaguucauugguacuguuggucucccugggggcaaucaguuuuuggaugugcucuaaugggucuuuacagugcagaauauguauuuaa

SEQ ID NO: 40336 - RNA, 1701 nt, Artificial Sequence
  hemagglutinin__InfluenzaA__AGB97269
augaaggcaauacuaguaguucugcuauauacauuugcaaccgcaaaugcagacacauuauguauagguuaccaugcgaacaacucaacagacacuguagacacaguacuagaaaagaauauaacaguaacacacucuguuaaucuucuagaagacaagcauaacgggaaacuaugcaaacuaagaggaguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaacacaacuugucagacacccaagggagcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggauggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40337 - RNA, 1701 nt, Artificial Sequence
  hemagglutinin__InfluenzaA__AGB97273
augaaggcaauacuaguaguucugcuauauacauuugcaaccgcaaaugcagacacauuauguauagguuaccaugcgaacaacucaacagacacuguagacacaguacuagaaaagaauguaacaguaacacacucuguuaaucuucuagaagacaagcauaacgggaaacuaugcaaacuaagaggaguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaacacaacuugucagacacccaagggagcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggauggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugauggguuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 40338 - RNA, 1701 nt, Artificial Sequence
  hemagglutinin__InfluenzaA__AGB97288
augaagacuaucauugcuuugggcuacauucuaugucugguuuucgcucaaaaacuuccuggaaaugacaauagcacggcaacgcugugucuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggaaaaaacuguacacuaauagaugcucuauugggagacccucagugugauggcuuucaaaauaagaaaugggaccuuuuuauugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcuaaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40339 - RNA, 1701 nt, Artificial Sequence
  hemagglutinin__InfluenzaA__AGB97292
augaagaccaucauugcuuugagcuacauucuuugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaaaggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40340 - RNA, 1701 nt, Artificial Sequence
  hemagglutinin__InfluenzaA__AGB97300
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaauggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaggaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40341 - RNA, 1701 nt, Artificial Sequence
  hemagglutinin__InfluenzaA__AGE89267
augaaggcaauacuaauaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccucaugcuggagaaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguuuaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaauccacgauugcaauacaacuugucagacacccaagggggcuauaaacaccagccucccauuucagaauauacauccgaucacaauuggaaaguguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguaggcaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40342 - RNA, 1701 nt, Artificial Sequence
  hemagglutinin__InfluenzaA__AGE89277
augaaggcaauacuaauaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugaacucagugucaucauuugaaagguuugaaauauuccccaagacaaguucauggcccaaucaugacucgaacaaagguguaacggcagcauguccucaugcuggagaaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguuuaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaauccacgauugcaauacaacuugucagacacccaagggggcuauaaacaccagccucccauuucagaauauacauccgaucacaauuggaaaguguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguaggcaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauuaguacugguagucucccugggggcaaucaguuucuggaugugcucuaaugggucucuacaguguagaauauguauuuaa

SEQ ID NO: 40343 - RNA, 1701 nt, Artificial Sequence
  hemagglutinin__InfluenzaA__AGE89287
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuauacauuugggggguucaccacccggguacggacaaggaccaaaucuuccuguaugcucaagcaucaggaagaaucacaguaucuaccaaaagaagccaacaagcuguacuuccgaauaucggaucuagacccagaguaaggaauaucccuagcagaguaagcaucuauuggacaauaguaaaaccgggagacauacuucugauuaacagcacagggaaucuaauugcuccuagggguuacuucaaaauacgaagugggaaaagcucaauaaugagaucagaugcacccauuggcaaaugcaauucuacaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaccaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40344 - RNA, 1701 nt, Artificial Sequence
  hemagglutinin__InfluenzaA__AGE89298
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccuaggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugauacugguagucucccugggggcaaucaguuuuuggaugugcucuaaugggucucuacaguguagaauauguauuuaa

SEQ ID NO: 40345 - RNA, 1701 nt, Artificial Sequence; identical to SEQ ID NO: 38862
  hemagglutinin__InfluenzaA__AGE89308

SEQ ID NO: 40346 - RNA, 1701 nt, Artificial Sequence
  hemagglutinin__InfluenzaA__AGE89318
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugaaggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40347 - RNA, 1701 nt, Artificial Sequence
  hemagglutinin__InfluenzaA__AGE89329
augaagacuaucauugcuuugagcuacauucuaugucugguuuucgcucaaaaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugagagcuucaauuggacuggagucacucaaaacggaacaagcucugcuugcauaaggagaucuaauaauaguuucuuuaguagauugaauugguugacccacuuaaacuucaaauacccagcuuugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaaacaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40348 - RNA, 1701 nt, Artificial Sequence; identical to SEQ ID NO: 37531
  hemagglutinin__InfluenzaA__AGE89340

SEQ ID NO: 40349 - RNA, 1701 nt, Artificial Sequence
  hemagglutinin__InfluenzaA__AGE89350
augaagaccaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40350 - RNA, 1701 nt, Artificial Sequence
  hemagglutinin__InfluenzaA__AGE89361
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacuacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 40351 - RNA, 1701 nt, Artificial Sequence
  hemagglutinin__InfluenzaA__AGE89371
augaagaccaucauugcuuugagcuacauucuaugucugguuuucgcucaaaaacuuccuggaaaugauaacagcacagcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugaaaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40352 - RNA, 1701 nt, Artificial Sequence
  hemagglutinin__InfluenzaA__AGE89382
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaaggugugacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguaaagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauaugugaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggagaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40353 - RNA, 1701 nt, Artificial Sequence
  hemagglutinin__InfluenzaA__AGE89392
augaagaccaucauugcuuugagcuacauucuaugucugguuuucgcucaagaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40354 - RNA, 1701 nt, Artificial Sequence; identical to SEQ ID NO: 40341
  hemagglutinin__InfluenzaA__AGE89422

SEQ ID NO: 40355 - RNA, 1701 nt, Artificial Sequence
  hemagglutinin__InfluenzaA__AGE89719
augaagaccaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacucacuuaaacuucaaauacccagcauugaacgugacuaugccaaacaaugaacaauuugacaaauuguacauuugggggguucaccacccggguacggacaaggaccaaaccuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40356 - RNA, 1701 nt, Artificial Sequence
  hemagglutinin__InfluenzaA__AGE89730
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuuuuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugggcaggggucaggauaugcagccgaccugaagagcacacagaaugccauugacaagauuacuaacaaaguaaauucuguuauugaaaagaugaauacacaguucacagcaguagguaaggaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40357 - RNA, 1701 nt, Artificial Sequence; identical to SEQ ID NO: 38876
  hemagglutinin__InfluenzaA__AGE89740

SEQ ID NO: 40358 - RNA, 1701 nt, Artificial Sequence
  hemagglutinin__InfluenzaA__AGE89751
augaagaccaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugccauggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaagcaaccguuuccagaucaagggaguugagcuaaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40359 - RNA, 1701 nt, Artificial Sequence; identical to SEQ ID NO: 38858
  hemagglutinin__InfluenzaA__AGE89762

SEQ ID NO: 40360 - RNA, 1701 nt, Artificial Sequence
  hemagglutinin__InfluenzaA__AGF44891
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaaugggacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugccagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccguugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40361 - RNA, 1701 nt, Artificial Sequence; identical to SEQ ID NO: 40360
  hemagglutinin__InfluenzaA__AGF44892

SEQ ID NO: 40362 - RNA, 1701 nt, Artificial Sequence
  hemagglutinin__InfluenzaA__AGF44895
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40363 - RNA, 1701 nt, Artificial Sequence
  hemagglutinin__InfluenzaA__AGF44896
augaagaccaucauugcuuugagcuacauucuuugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaaaggaguugagcugaagucaggguacaaagauuggauccuauggauuuccuuugccauaucauguuuuuuacuuuguguugcuuuguugggguucaucaugugggccugccaaaaaggcaacauuaggugcaacauuugcauuuga

SEQ ID NO: 40364 - RNA, 1701 nt, Artificial Sequence
  hemagglutinin__InfluenzaA__AGF44897
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcaugaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggauccagacccagaguaaggaauaucccuagcagaguaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugcuugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40365 - RNA, 1701 nt, Artificial Sequence
  hemagglutinin__InfluenzaA__AGF44900
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagguuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuauuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40366 - RNA, 1701 nt, Artificial Sequence
  hemagglutinin__InfluenzaA__AGF44901
augaagacuaucauugcuuugagcuacauucuaugucugguuuucgcucaaaaacuuccuggaaaugacaauagcacggcaacgcugugccuugggcaccaugcaguaccaaauggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauauuccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggaggggaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40367 - RNA, 1701 nt, Artificial Sequence; identical to SEQ ID NO: 40366
  hemagglutinin__InfluenzaA__AGF44902

SEQ ID NO: 40368 - RNA, 1701 nt, Artificial Sequence; identical to SEQ ID NO: 40366
  hemagglutinin__InfluenzaA__AGF44903

SEQ ID NO: 40369 - RNA, 1701 nt, Artificial Sequence; identical to SEQ ID NO: 40366
  hemagglutinin__InfluenzaA__AGF44904

SEQ ID NO: 40370 - RNA, 1701 nt, Artificial Sequence
  hemagglutinin__InfluenzaA__AGF44905
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauuaaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaacacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugccuuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40371 - RNA, 1701 nt, Artificial Sequence
  hemagglutinin__InfluenzaA__AGF44906
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40372 - RNA, 1701 nt, Artificial Sequence
  hemagglutinin__InfluenzaA__AGF44908
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40373 - RNA, 1701 nt, Artificial Sequence; identical to SEQ ID NO: 40366
  hemagglutinin__InfluenzaA__AGF44909

SEQ ID NO: 40374 - RNA, 1701 nt, Artificial Sequence; identical to SEQ ID NO: 40366
  hemagglutinin__InfluenzaA__AGF44910

SEQ ID NO: 40375 - RNA, 1701 nt, Artificial Sequence
  hemagglutinin__InfluenzaA__AGF44911
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauauggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccacaucauguuuuuugcuuuguguugcuuuguugggguucaucaugugggccugccaaaagggcaacauuaggugcaacauuugcauuuga

SEQ ID NO: 40376 - RNA, 1701 nt, Artificial Sequence; identical to SEQ ID NO: 40366
  hemagglutinin__InfluenzaA__AGF44912

SEQ ID NO: 40377 - RNA, 1701 nt, Artificial Sequence; identical to SEQ ID NO: 40371
  hemagglutinin__InfluenzaA__AGF44913

SEQ ID NO: 40378 - RNA, 1701 nt, Artificial Sequence
  hemagglutinin__InfluenzaA__AGF44914
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauauuggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaagaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40379 - RNA, 1701 nt, Artificial Sequence
  hemagglutinin__InfluenzaA__AGF44916
augaagaccaucauugcuuugagcuacauucuaugucuaguuuuugcucaagaacuuccuggaaaugacgacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaacgguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40380 - RNA, 1701 nt, Artificial Sequence
  hemagglutinin__InfluenzaA__AGF44917
augaagacuaucauugcuuugagcuacauucuaugucugguuuucgcucaaaaaauuccuggaaaugacaacagcacggcaacgcugugccuugggcaccaugcaguaccaaacggaacgauagugaaaacaauuacgaaugaacaaauugaaguuacuaaugcuacugagcugguucagaguuccucaacaggcgaaauaugcaacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggggaucugauaguaguuucuuuaguagauugaauugguugacccacuuaaacuucaaauacccagcauuaaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcugugaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggaaaaugcaauucugaaugcaucacuccaaauggaagcauucccaaugacaaaccauuccaaaauguaaacaggaucacauacggggccugucccagauacguuaagcaaaacacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcuaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggaaaaccaacauacaauugaucuaacugacucagaaaugaacaaacuguuugaaaaaacaaagaagcaacugagggaaaaugcugaggauaugggcaauggcuguuucaaaauauaccacaaaugugacaaugccugcauaggaucaaucagaaauggaacuuauaaccacgauguauacagagaugaagcauuaaacaaccgguuccagaucaagggaguugagcugaagucgggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40381 - RNA, 1701 nt, Artificial Sequence
  hemagglutinin__InfluenzaA__AGF44918
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggauccagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugcuugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40382 - RNA, 1701 nt, Artificial Sequence
  hemagglutinin__InfluenzaA__AGF44919
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacuauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40383 - RNA, 1701 nt, Artificial Sequence; identical to SEQ ID NO: 40381
  hemagglutinin__InfluenzaA__AGF44920

SEQ ID NO: 40384 - RNA, 1701 nt, Artificial Sequence
  hemagglutinin__InfluenzaA__AGF44921
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40385 - RNA, 1701 nt, Artificial Sequence
  hemagglutinin__InfluenzaA__AGG13411
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccgaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaaagaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaaaccaacaaacuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaaguggaaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggugcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40386 - RNA, 1701 nt, Artificial Sequence
  hemagglutinin__InfluenzaA__AGG13447
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccgaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaaagaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaaacuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaaguggaaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggugcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacacagaagcaacuuagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40387 - RNA, 1701 nt, Artificial Sequence
  hemagglutinin__InfluenzaA__AGG13459
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacuaagggaaaaugcugaggauaugggcaaugguuguuucaaaauauaccacaaaugugacaaugccugcauaggaucaaucagaaauggaacuuacgaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40388 - RNA, 1701 nt, Artificial Sequence
  hemagglutinin__InfluenzaA__AGG13495
augaagacuaucauugcuuugagcuacauucuaugucuaguuuucgcccaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucugauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaaucugugaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggaaaaugcaauucugaaugcaucacuccaaauggaagcauucccaaugacaaaccauuccaaaauguaaacaggaucacauacggggccuguccuagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggaaaaccaacauacaauugaucuaacugacucagaaaugaacaaacuguuugaaaaaacaaagaagcaacugagagaaaaugcugaagauaugggcaauggcuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40389 - RNA, 1701 nt, Artificial Sequence
  hemagglutinin__InfluenzaA__AGG13507
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaucuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40390 - RNA, 1701 nt, Artificial Sequence
  hemagglutinin__InfluenzaA__AGG13519
augaagacuaucauugcuuugagcuacauucuaugucuaguuuucgcccaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucugauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaaucugugaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggaaaaugcaauucugaaugcaucacuccaaauggaagcauucccaaugacaaaccauuccaaaauguaaacaggaucacauacggggccuguccuagauauguuaagcaaaacacucugaaauuggcaacaggaaugcgaaauguaccagagaaacaaacuagaggcauauuuggcgcaauagcggguuucauagaaaauggaugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaguucaggaccuugagaaauauguugaggacacuaaaauagaucucuggucauacaacgcggagcuucuuguugcccuggaaaaccaacauacaauugaucuaacugacucagaaaugaacaaacuguuugaaaaaacaaagaagcaacugagagaaaaugcugaagauaugggcaauggcuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40391 - RNA, 1701 nt, Artificial Sequence
  hemagglutinin__InfluenzaA__AGG13531
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacuaagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40392 - RNA, 1701 nt, Artificial Sequence
  hemagglutinin__InfluenzaA__AGG13543
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgucacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggacauugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40393 - RNA, 1701 nt, Artificial Sequence
  hemagglutinin__InfluenzaA__AGG13555
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40394 - RNA, 1701 nt, Artificial Sequence; identical to SEQ ID NO: 40393
  hemagglutinin__InfluenzaA__AGG13567

SEQ ID NO: 40395 - RNA, 1701 nt, Artificial Sequence
  hemagglutinin__InfluenzaA__AGG13591
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucaaauccuugauggagaaaacugcacgcuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaaacuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccgggcacagacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacagaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40396 - RNA, 1701 nt, Artificial Sequence
  hemagglutinin__InfluenzaA__AGG13615
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccagugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40397 - RNA, 1701 nt, Artificial Sequence
  hemagglutinin__InfluenzaA__AGG13627
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucaaauccuugauggagaaaacugcacgcuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaaacuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccgggcacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacagaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40398 - RNA, 1701 nt, Artificial Sequence
  hemagglutinin__InfluenzaA__AGG13639
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacgaacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacgauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40399 - RNA, 1701 nt, Artificial Sequence; identical to SEQ ID NO: 40388
  hemagglutinin__InfluenzaA__AGG13651

SEQ ID NO: 40400 - RNA, 1701 nt, Artificial Sequence; identical to SEQ ID NO: 40391
  hemagglutinin__InfluenzaA__AGG13663

SEQ ID NO: 40401 - RNA, 1701 nt, Artificial Sequence; identical to SEQ ID NO: 40388
  hemagglutinin__InfluenzaA__AGG13675

SEQ ID NO: 40402 - RNA, 1701 nt, Artificial Sequence; identical to SEQ ID NO: 40393
  hemagglutinin__InfluenzaA__AGG13687

SEQ ID NO: 40403 - RNA, 1701 nt, Artificial Sequence; identical to SEQ ID NO: 40388
  hemagglutinin__InfluenzaA__AGG13711

SEQ ID NO: 40404 - RNA, 1701 nt, Artificial Sequence
  hemagglutinin__InfluenzaA__AGG13723
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagauccaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40405 - RNA, 1701 nt, Artificial Sequence; identical to SEQ ID NO: 40393
  hemagglutinin__InfluenzaA__AGG13735

SEQ ID NO: 40406 - RNA, 1701 nt, Artificial Sequence; identical to SEQ ID NO: 40393
  hemagglutinin__InfluenzaA__AGG13747

SEQ ID NO: 40407 - RNA, 1701 nt, Artificial Sequence
  hemagglutinin__InfluenzaA__AGG13759
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccgaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaaagaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaaacuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaaguggaaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggugcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40408 - RNA, 1701 nt, Artificial Sequence
  hemagglutinin__InfluenzaA__AGG13771
augaagacuaucauugcuuugagcuacauucuaugucuaguuuucgcccaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucugauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaaucugugaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggaaaaugcaauucugaaugcaucacuccaaauggaagcauucccaaugacaaaccauuccaaaauguaaacaggaucacauacggggccuguccuagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggauaauaaaauagaucucuggucauacaacgcggagcuucuuguugcccuggaaaaccaacauacaauugaucuaacugacucagaaaugaacaaacuguuugaaaaaacaaagaagcaacugagagaaaaugcugaagauaugggcaauggcuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40409 - RNA, 1701 nt, Artificial Sequence
  hemagglutinin__InfluenzaA__AGG13783
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaaugggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaaugucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucagguuacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40410 - RNA, 1701 nt, Artificial Sequence
  hemagglutinin__InfluenzaA__AGG13795
augaagacuaucauugcuuugagcuacauucuaugucuaguuuucgcccaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcccuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucugauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaaucugugaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggaaaaugcaauucugaaugcaucacuccaaauggaagcauucccaaugacaaaccauuccaaaauguaaacaggaucacauacggggccuguccuagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggaaaaccaacauacaauugaucuaacugacucagaaaugaacaaacuguuugaaaaaacaaagaagcaacugagagaaaaugcugaagauaugggcaauggcuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40411 - RNA, 1701 nt, Artificial Sequence
  hemagglutinin__InfluenzaA__AGG13807
augaagaccaucauugcuuugagcuacauucuuugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagguugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaaaggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40412 - RNA, 1701 nt, Artificial Sequence; identical to SEQ ID NO: 40388
  hemagglutinin__InfluenzaA__AGG13819

SEQ ID NO: 40413 - RNA, 1701 nt, Artificial Sequence; identical to SEQ ID NO: 40388
  hemagglutinin__InfluenzaA__AGG13831

SEQ ID NO: 40414 - RNA, 1701 nt, Artificial Sequence
  hemagglutinin__InfluenzaA__AGG13855
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaguuggcaacaggaaugcgaaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40415 - RNA, 1701 nt, Artificial Sequence
  hemagglutinin__InfluenzaA__AGG13867
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauagguaaaauaugcgacaguccucaucagauccuugauggagaaaauugcacacuaauggaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagauccaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40416 - RNA, 1701 nt, Artificial Sequence
  hemagglutinin__InfluenzaA__AGG13879
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaucacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacuaagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40417 - RNA, 1701 nt, Artificial Sequence; identical to SEQ ID NO: 40391
  hemagglutinin__InfluenzaA__AGG13891

SEQ ID NO: 40418 - RNA, 1701 nt, Artificial Sequence
  hemagglutinin__InfluenzaA__AGG13903
augaagacuaucauugcuuugagcuacauucuaugucuaguuuucgcccaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucugauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaaucugugcucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggaaaaugcaauucugaaugcaucacuccaaauggaagcauucccaaugacaaaccauuccaaaauguaaacaggaucacauacggggccuguccuagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggaaaaccaacauacaauugaucuaacugacucagaaaugaacaaacuguuugaaaaaacaaagaagcaacugagagaaaaugcugaagauaugggcaauggcuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40419 - RNA, 1701 nt, Artificial Sequence; identical to SEQ ID NO: 40393
  hemagglutinin__InfluenzaA__AGG13927

SEQ ID NO: 40420 - RNA, 1701 nt, Artificial Sequence
  hemagglutinin__InfluenzaA__AGG13939
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucaaauccuugauggagaaaacugcacgcuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaaacuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccgggcacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacagaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucauuaugugggccugccaaaagggcaacauuaggugcaacauuugcauuuga

SEQ ID NO: 40421 - RNA, 1701 nt, Artificial Sequence
  hemagglutinin__InfluenzaA__AGG13962
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaggguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcugaaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcagggaucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40422 - RNA, 1701 nt, Artificial Sequence
  hemagglutinin__InfluenzaA__AGG13973
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuaggcccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacuaagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40423 - RNA, 1701 nt, Artificial Sequence
  hemagglutinin__InfluenzaA__AGG13985
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacagcccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugcuugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40424 - RNA, 1701 nt, Artificial Sequence; identical to SEQ ID NO: 40423
  hemagglutinin__InfluenzaA__AGG13997

SEQ ID NO: 40425 - RNA, 1701 nt, Artificial Sequence; identical to SEQ ID NO: 40391
  hemagglutinin__InfluenzaA__AGG14009

SEQ ID NO: 40426 - RNA, 1701 nt, Artificial Sequence
  hemagglutinin__InfluenzaA__AGG14021
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucuuuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaauugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40427 - RNA, 1701 nt, Artificial Sequence; identical to SEQ ID NO: 40388
  hemagglutinin__InfluenzaA__AGG14033

SEQ ID NO: 40428 - RNA, 1701 nt, Artificial Sequence; identical to SEQ ID NO: 40407
  hemagglutinin__InfluenzaA__AGG14318

SEQ ID NO: 40429 - RNA, 1701 nt, Artificial Sequence
  hemagglutinin__InfluenzaA__AGG14330
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaauaagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40430 - RNA, 1701 nt, Artificial Sequence
  hemagglutinin__InfluenzaA__AGG84179
augaagaccaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaagugaaauaugcgacaguccucaucauauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagguugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40431 - RNA, 1704 nt, Artificial Sequence
  hemagglutinin__InfluenzaA__AGI02564
auggagaaaauagugcuucuucuugcaauagucagccuuguuaaaagugaucagauuugcauugguuaccaugcaaacaacucgacagagcagguugacacgauaauggaaaagaacguuacuguuacacaugcccaagacauacuggaaaagacacacaacgggaagcucugcgaucuagauggagugaagccucugauuuuaagagauuguaguguagcuggauggcuccucggaaacccaaugugugacgaauucaucaaugugccggaauggucuuacauaguggagaaggccaacccaaccaaugaccucuguuacccagggaauuucaacgacuaugaagaacugaaacaccuauugagcagaauaaaccauuuugagaaaauucagaucauccccaagaguucuugguccggccaugaagccucaucaggggugagcucagcauguccauaccagggaacgcccuccuuuuucagaaaugugguauggcuuaucaaaaagaacaauacauacccaacaauaaagagaagcuacaauaauaccaaccaggaagaucuuuugauacugugggggauucaucauucuaaugaugcggcagagcagacaaagcucuaucaaaacccaaccaccuauauuuccguugggacaucaacacuaaaccagagauugguaccaaaaauagcuacuagauccaaaguaaacgggcaaaguggaaggauggauuucuucuggacaauuuuaaaaccgaaugaugcaaucaacuucgagaguaauggaaauuuuauugcuccagaauaugcauacaaaauugucaagaaaggggacucagcaauuaugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcgacugggcucagaaauaguccucuaagagaaagaagaagaaaaagaggacuauuuggagcuauagcagguuuuauagagggaggauggcagggaaugguagaugguugguauggguaccaccauagcaaugagcaggggaguggguacgcugcagacaaagaauccacucaaaaggcaauagauggaguuaccaauaaggucaacucgaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuaggaauaaugcaaaggagcuggguaaugguuguuucgaguucuaucacaaaugugauaaugaauguauggaaaguguaagaaacggaacguaugacuacccacaguauucagaagaagcaagauuaaaaagagaggaaauaaguggaguaaaauuggaaucaauaggaacuuaccaaauacugucaauuuauucaacaguggcgaguucucuagcacuggcaaucaugguggcuggucuaucuuuauggaugugcuccaaugggucguuacaaugcagaauuugcaucuag

SEQ ID NO: 40432 - RNA, 1707 nt, Artificial Sequence
  hemagglutinin__InfluenzaA__AGI02565
auggagaaaauagugcuucuucuugcaauagucagucuuguuaaaagugaucagauuugcauugguuaccaugcaaacaacucgacagagcagguugacacaauaauggaaaagaacguuacuguuacacaugcccaagacauacuggaaaagacacacaacggaaagcucugcgaccucgauggagugaagccucuaauuuugagagauuguaguguagcuggauggcuccucgggaacccaaugugugacgaauucaucaauguaccggaauggucuuacauaguggagaaggccauuccagccaaugaccucuguuacccaggggauuucaacgacuaugaagaacugaaacaccuauugagcagaauaaaccauuuugagaaaauucagaucauccccaaaaguucuugguccaaucaugaagccucauuaggggugagcucagcauguccauaccugggaaagcccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguuggaacaucaacacuaaaccagagauugguaccaaaaauagcuacuagauccaaaguaaacgggcaaaguggaaggauggaguucuucuggacaauuuugaaaccgaaugaugcaaucaacuucgagaguaauggaaauuucauugcuccagaauaugcauacaaaauugucaagaaaggggacucagcaauuaugaaaagugaauuggaauaugguaauugcaacaccaagugccaaacuccaaugggggcgauaaacucuaguaugccauuccacaacauacacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggauaccaccauagcaaugagcaggggaguggauacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaagauggaagacggauuccuagaugucuggacuuauaaugcugaacuucugguucucauggaaaaugagagaacucuagacuuucaugauucaaaugucaagaaccuuuaugacaagguccgacuacagcuuagggauaaugcaaaagagcuggguaacgguuguuucgaguucuaucacaaaugugauaaugaauguauggaaaguguaagaaacggaacguaugacuacccgcaguauucagaagaagcaagacuaaaaagagaggaaauaaguggaguaaaauuggaaucaauaggaacuuaccaaauacugucaauuuauucaacaguggcgaguucccuagcacuggcaaucaugguagcuggucuaucuuuauggaugugcuccaaugguucguuacaaugcagaauuugcauuuaa

SEQ ID NO: 40433 - RNA, 1704 nt, Artificial Sequence
  hemagglutinin__InfluenzaA__AGI02566
auggagaaaauagugcuucuucuugcaauagucagccuuguuaaaagugaucagauuugcaucgguuaccaugcaaacaacucgacagagcagguugacacaauaauggaaaagaacguuacuguuacacaugcccaagacauacuggagaagacacauaacgggaaacucugcgaucuagauggagugaagccucugauucuacgagauuguaguguagcuggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucagcauguccauaccagggaacgcccuccuuuuucagaaaugugguauggcuuaucaaaaagaacaauacauacccaacaauaaagagaagcuacaauaauaccaaccaggaaaaucuuuugauacugugggggauucaucauuccaaugaugcagcagagcagauaaagcucuaucaaaacccaaccaccuauauuuccguugggacaucaacacuaaaccagagauugguaccaaaaauagccacuagauccaaaguaaacgggcaaaguggaaggauggauuucuucuggacaauuuuaaaaccgaaugaugcaaucaacuucgagaguaauggaaauuucauugcuccagaauaugcauacaaaauugucaaggaaggagacucagcaauuaugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcuacugggcucagaaauaguccucuaagagaaagaagaagaaaaagaggacuauuuggagcuauagcaggguuuauagagggaggauggcagggaaugguagaugguugguauggguaccaccauagcaaugagcaggggaguggguacgcugcagacaaagaauccacucaaaaggcaauagauggagucaccaauaaggucaacucgaucauugauaaaaugaacacucaguuugaggccguuggaagggaauuuaauaacuuggaaaggagaauagagaacuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggagcuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuguggaugugcuccaaugggucguuacaaugcagaauuugcauuuaa

SEQ ID NO: 40434 - RNA, 1707 nt, Artificial Sequence
  hemagglutinin__InfluenzaA__AGI02567
auggagaaaauagugcuucuucuugcaauagucagucuuguuaaaagugaucagauuugcauugguuaccaugcaaacaacucgacagagcagguugacacaauaauggaaaagaacgucacuguuacacaugcccaagacauacuggaaaagacacacaacgggaagcucugcgaucuagauggagugaagccucuaauuuuaagagauuguaguguagcuggauggcuccucgggaacccaaugugugacgaauuccucaaugugccggaauggucuuacauaguggagaaggccaauccagccaaugaccucuguuacccagggaauuucaacgacuaugaagaacugaaacaccuauugagcagaauaaaccauuuugagaaaauucaaaucauccccaaaaguucuuggucagaucaugaagccucaucaggggugagcucagcauguccauaccagggaagguccuccuuuuucagaaaugugguauggcuuaucaaaaagaacaaugcauacccaacaauaaagagaaguuacaauaauaccaaccaagaagaucuuuugguacugugggggauucaccauccaaaugaugcggcagagcagacaaggcucuaucaaaacccaaccaccuauauuuccguugggacaucaacacuaaaccagagauugguaccaaaaauagcuacuagauccaaaguaaacgggcaaagugggaggauggaguucuucuggacaauuuuaaaaccgaaugaugcaaucaacuuugagaguaauggaaauuucauugcuccagaauaugcauacaaaauugucaagaaaggggacucaacaauuaugaaaagugaauuggaauaugguaacugcaacaccaagugucaaacuccaauaggggcgauaaacucuaguaugccauuccacaacauccacccucucaccaucggggaaugccccaaauaugugaaaucaaacagauuaguccuugcgacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaaggaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuaucuuuauggaugugcuccaauggaucguuacaaugcagaauuugcaucuag

SEQ ID NO: 40435 - RNA, 1704 nt, Artificial Sequence
  hemagglutinin__InfluenzaA__AGI02568
auggagaaaauagugcuucuucuugcaauagucagccuuguuaaaagugaucagauuugcaucgguuaccaugcaaacaacucgacagagcagguugacacaauaauggaaaagaacguuacuguuacacaugcccaagacauacuggagaagacacauaacgggaaacucugcgaucuagauggagugaagccucugauucuacgagauuguaguguagcuggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucagcauguccauaccagggaacgcccuccuuuuucagaaaugugguauggcuuaucaaaaagaacaauacauacccaacaauaaagagaagcuacaauaauaccaaccaggaaaaucuuuugauacugugggggauucaucauucuaaugaugcaacagagcagauaaagcucuaucaaaacccaaccaccuauauuuccguugggacaucaacacuaaaccagagauugguaccaaaaauaggcacuagauccaaaguaaacgggcaaaguggaaggauggauuucuucuggacaauuuuaaaaccgaaugaugcaaucaacuucgagaguaauggaaauuucauugcuccagaauaugcauacaaaauugucaaggaaggagacucagcaauuaugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcuacugggcucagaaauaguccucuaagagaaagaagaagaaaaagaggacuauuuggagcuauagcaggguuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaacuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggagcuggguaacgguuguuucgaguucuaucacaaaugugauaaugaauguauggaaaguguaagaaacggaacguaugacuacccgcaguauucagaggaagcaagauuaaaaagagaggaaauaaguggaguaaaauuggaaucaaugggaauuuaccaaauacugucaauuuauucaacaguugcgaguucucuagcacuggcaaucaugguggcuggucuaucuuuguggaugugcuccaaugggucguuacaaugcagaauuugcauuuaa

SEQ ID NO: 40436 - RNA, 1683 nt, Artificial Sequence
  hemagglutinin__InfluenzaA__AGI60301
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaaugguauaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugaucgacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 40437 - RNA, 1683 nt, Artificial Sequence
  hemagglutinin__InfluenzaA__AGJ72861
augaacacucaaauccugguauucgcucugauugcgaucauuccaacaaaugcagacaaaaucugccucggacaucaugccgugucaaacggaaccaaaguaaacacuuuaacugaaagaggaggggaagucgucaaugcaacugaaacaguggaacgaacaaacauccccaggaucugcucaaaggggaaaaagacaguugaccucggucaagggggaccccgggggacaaucacuggaccaccucaaugugaccaauuccuagaauuuucagccgauuuaauuauggagaggcgagaaggaagugaugucuguuauccggggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucaaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 40438 - RNA, 1701 nt, Artificial Sequence
  hemagglutinin__InfluenzaA__AGJ73327
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaaguuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaccaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccaggagacaaaauaacauucgaagcaacuggaaaucuagugguaccgagauaugcauucgcaauggaaagaaaugcuggaucugguauuaucauuccagauacaccaguccacgauugcaauacaacuugucagacacccaagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaacuugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaagaauuuaccagauuuuggcgaucuauucaacugucgccaguucauugguacugguagucucccugggggaaaucaguuucuggaugugcucuaaugggucucuacaguguagaauauguauuuaa

SEQ ID NO: 40439 - RNA, 1701 nt, Artificial Sequence
  hemagglutinin__InfluenzaA__AGJ73329
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagaugcaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40440 - RNA, 1701 nt, Artificial Sequence
  hemagglutinin__InfluenzaA__AGJ73331
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccguccauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaacucuguuauugaaaaaaugaauacacaguucacagcaguagguaaagaguucaaccaccuggaaaaaagaauagagaauuuaaacaaaaaaguugaugaugguuuccuggacauuuggacuuacaaugccgaacuguugguucuauuggaaaaugaaagaacuuuggacuaccacgauucaaaggugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40441 - RNA, 1701 nt, Artificial Sequence
  hemagglutinin__InfluenzaA__AGJ73333
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccaaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40442 - RNA, 1701 nt, Artificial Sequence
  hemagglutinin__InfluenzaA__AGJ73335
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgagagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccguccauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40443 - RNA, 1701 nt, Artificial Sequence
  hemagglutinin__InfluenzaA__AGJ73337
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucaguaucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagccucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaaggugagaaaccaguuaaaaaacaaugccaaggaaauuggaaauggcugcuuugaauuuuaccacaaaugcgauaacacgugcauggaaagugucaaaaaugggacuuaugacuacccaaaauacucugaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40444 - RNA, 1701 nt, Artificial Sequence
  hemagglutinin__InfluenzaA__AGJ73339
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40445 - RNA, 1701 nt, Artificial Sequence
  hemagglutinin__InfluenzaA__AGJ73341
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauuggugcugguagucucccugggggcaaucaguuucuggaugugcucuaaugggucucuacaguguagaauauguauuuaa

SEQ ID NO: 40446 - RNA, 1701 nt, Artificial Sequence
  hemagglutinin__InfluenzaA__AGJ73343
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcaaaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40447 - RNA, 1701 nt, Artificial Sequence
  hemagglutinin__InfluenzaA__AGJ73345
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugaagaugcauauguuuuuguggggacaucaaaauacagcaagaaguucaagccggaaauagcaguaagacccaaagugagggaucaagaagggagaaugaacuauuacuggacacuaguagagccgggaaacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40448 - RNA, 1701 nt, Artificial Sequence
  hemagglutinin__InfluenzaA__AGJ73347
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagaccaaaagugagggaucaagaagggagaaugaacuauuacuggacacuaguagagccaggagacaaaauaacauucgaagcaacuggaaaucuauugguaccgagauaugcauucgcaauggaaagaaaugcuggaucugguauuaucauuucagauacaccaguccacgauugcaauacaaccugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40449 - RNA, 1701 nt, Artificial Sequence
  hemagglutinin__InfluenzaA__AGJ73349
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuggaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggauauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40450 - RNA, 1701 nt, Artificial Sequence
  hemagglutinin__InfluenzaA__AGJ73351
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauucugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaaaugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40451 - RNA, 1701 nt, Artificial Sequence
  hemagglutinin__InfluenzaA__AGJ73353
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauuggugccgagauaugcauucgcaauggaaagaaaugcuggaucugguauuaucauuucagauacaccaguccaugauugcaauacaacuugucagacacccaagggugcuauaaacaccagccucccauuucagaguauacauccgauuacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40452 - RNA, 1701 nt, Artificial Sequence
  hemagglutinin__InfluenzaA__AGJ73355
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagaggaguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaagggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauauucagaggaagcaaaauuaaacagagaagaaauagaugggguaaagcuggaaucaacaaggauuuaccagauuuuggcgaucuauucaacugucgccaguucauugguacugguagucucccugggggcaaccaguuucuggaugugcucuaaugggucucuacaguguagaauauguauuuaa

SEQ ID NO: 40453 - RNA, 1701 nt, Artificial Sequence; identical to SEQ ID NO: 40275
  hemagglutinin__InfluenzaA__AGJ73357

SEQ ID NO: 40454 - RNA, 1701 nt, Artificial Sequence
  hemagglutinin__InfluenzaA__AGJ73361
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacaucaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuuucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40455 - RNA, 1701 nt, Artificial Sequence
  hemagglutinin__InfluenzaA__AGJ73363
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40456 - RNA, 1701 nt, Artificial Sequence
  hemagglutinin__InfluenzaA__AGJ73365
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40457 - RNA, 1701 nt, Artificial Sequence
  hemagglutinin__InfluenzaA__AGJ73367
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagaggaguagccccauugcauuuggguaaauguaacauugcuggcuggauccugggaaauccagagugugaaucacucuccacagcaagcucauggcccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguagcggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccaggauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucgaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40458 - RNA, 1701 nt, Artificial Sequence
  hemagglutinin__InfluenzaA__AGJ73369
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucuuuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagcggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40459 - RNA, 1701 nt, Artificial Sequence; identical to SEQ ID NO: 40444
  hemagglutinin__InfluenzaA__AGJ73371

SEQ ID NO: 40460 - RNA, 1701 nt, Artificial Sequence
  hemagglutinin__InfluenzaA__AGJ73373
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccacccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40461 - RNA, 1701 nt, Artificial Sequence
  hemagglutinin__InfluenzaA__AGJ73375
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccgagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40462 - RNA, 1701 nt, Artificial Sequence
  hemagglutinin__InfluenzaA__AGJ73377
augaaggcaauacuaguaguucugcuauauacauuugcaaccgcaaaugcagacacauuauguauagguuaucaugcgaacaauucaacagacacuguagacacaguacuagaaaagaauguaacaguaacucacucuguuaaccuucuagaagacaagcauaacgggaaacuaugcaaacuaagagggguagccccauugcauuuggguaaauguaacauugcgggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcaucauguccucgugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacgucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccguccauucaaucuagaggccuauuuggagccauugccggcuucauugaagggggauggacaggaaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuaaccacaaaugcgauaacacgugcauggaaagugucaaaaaugggacuuaugacuacccaaaauacucagaagaagcaaaauuaaacaaagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40463 - RNA, 1701 nt, Artificial Sequence
  hemagglutinin__InfluenzaA__AGJ73380
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaauagagccaggagacaaaauaacauucgaagcaacuggaaaucuagugguaccgagauaugcauucgcaauggaaagaaaugcuggaucugguauuaucauuucagauacaccaguccacgauugcaauucaacuugucagacacccaagggugcuauaaacaccagccucccauuucagaauauacauccgaucacaauuggaaaauguccaaaguauguaaaaagcacaaaauugagacuggccacaggauuaaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauauggacuuacaaugccgaacuguuuguucuauuggaaaaugaaagaacuuuggacuaccacgauucaaaugugaaggacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40464 - RNA, 1701 nt, Artificial Sequence
  hemagglutinin__InfluenzaA__AGK62991
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggggaaaacugcacacuaauagaugcucuauugggagacccucagugugauggcuuccaaaacaagaaaugggaccuuuuuguugaacgaagcaaagccuacagcaacuguuacccuuaugaugugccggauuaugccucccuuaggucacuaguugccucguccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40465 - RNA, 1701 nt, Artificial Sequence
  hemagglutinin__InfluenzaA__AGK62993
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggggaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuagcaaaugcaauucugcaugcaucacuacaaauggaagcauuccuaaugacaaaccauuccaaaauguuaacaggaucacauacggggccugucccagauauguuaagcaaaacacucugaaauuggcaacaggaaugagaaauguaccagagaaacaaacuagaggcauauuuggcgcaaucgcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugguccugccaaaaaggcaacauuaggugcaacauuugcauuuga

SEQ ID NO: 40466 - RNA, 1701 nt, Artificial Sequence
  hemagglutinin__InfluenzaA__AGK62995
augaagacuaucauugcuuugagcuacauucuaugucugguuuucgcucaaaaacuuccuggaaaugacaacagcacggcaacgcugugccuugggcaccaugcaggaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucggaaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40467 - RNA, 1701 nt, Artificial Sequence
  hemagglutinin__InfluenzaA__AGK62997
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugacaaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacaugcggggccugugccagauauguuaagcaaaacacucugaaauuggcgacaggaaugagaaauguaccagagaaacaaacuagaggcauauuuggcgcaauagcgguuuucauagaaaaugguugggagggaaugguggaugguugguacgguuucaggcaucaaaauucugagggaagagaacaagcagcagcuuuucaaagcacucaagcagcaaucgaccaaaucauugggaagcugaauagauugaucggggaaaccaacgagaaauuccaucagauugaaaaagaauucucagaagucgaaaggagaauucaggcccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugguccugccaaaaaggcaacauuaggugcaacauuugcauuuga

SEQ ID NO: 40468 - RNA, 1701 nt, Artificial Sequence
  hemagglutinin__InfluenzaA__AGK62999
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggaaggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40469 - RNA, 1701 nt, Artificial Sequence
  hemagglutinin__InfluenzaA__AGK63001
augaagacuaucauugcuuugagcuacauucuaugucugguuuucgcucaaaaacuuccuggaaaugacaacagcacggcaacgcugugccuugugcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaaggaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauggguugacccacuuaaauuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcggaauguaccagagaaacaaacuagaggcauauuuggcgcaauagcagguuucauagaaaaugguugggagggaaugguggaugguugguacgguuucaggcaucaaaauucugagggaagggagcaagcagcagauuuucaaagcacucaagcagcaaucgaucaaaucauugggaagcugaaucgauugaucgggaaaaccaacgagaaauuccaucagauugaaaaagaauucucagaagucgaaaggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugguccugccaaaagggcaacauuaggugcaacauuugcauuuga

SEQ ID NO: 40470 - RNA, 1701 nt, Artificial Sequence
  hemagglutinin__InfluenzaA__AGK63003
augaagacuaucauugcuuugagcuacauucuaugucugguuuucgcucaaaaacuuccuggaaaugacaacagcacggcaacgcugugccuugggcaccaugcaggaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40471 - RNA, 1701 nt, Artificial Sequence
  hemagglutinin__InfluenzaA__AGK63005
augaagacuaucauugcuuugagcuacauucuaugucugguuuucgcucaaaaacuuccuggaaaugacaacagcacggcaacgcugugccuugugcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacugauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauuaggagaucuaauaguaguuucuuuaguagauugaauggguugacccacuuaaacuucaaauacccagcauuggacgugacuaugccaaacaaugacaaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcgguuuucauagaaaaugguugggagggaaugguggaugguugguacgguuucaggcaucaaaauucugagggaagagagcaagcagcggauuuucaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40472 - RNA, 1701 nt, Artificial Sequence
  hemagglutinin__InfluenzaA__AGK63007
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguuaacaggaucacauacggggccugucccagauauguuaagcaaaacacucugaaauuggcaacaggaaugagaaauguaccagagaaacaaacuagaggcauauuuggcgcaauagcggguuucauagaaaaugguugggaaggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40473 - RNA, 1701 nt, Artificial Sequence
  hemagglutinin__InfluenzaA__AGK63009
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggccuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaaucgcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40474 - RNA, 1701 nt, Artificial Sequence
  hemagglutinin__InfluenzaA__AGK63011
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuucuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucagacaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40475 - RNA, 1701 nt, Artificial Sequence
  hemagglutinin__InfluenzaA__AGK63013
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauuaggagaucuaauaauaguuucuuuaguagauugaauugguugacccacuuaaacuucaaauacccagcauuggacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugugccagauauguuaagcaaaacacucugaaauuggcgacaggaaugagaaauguaccagagaaacaaacuagaggcauauuuggcgcaauagcgguuuucauagaaaaugguugggagggaaugguggaugguugguacgguuucaggcaucaaaauucugagggaagggggcaagcagcggcucuccaaagcacucaagcagcaaucgaucaaaucacugggaagcugaauagauugaucggggaaaccaacgagaaauuccaucagauugaaaaagaauucucagaagucgaagggagaauucaggcccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugguccugccaaaaaggcaacauuaggugcaacauuugcauuuga

SEQ ID NO: 40476 - RNA, 1701 nt, Artificial Sequence
  hemagglutinin__InfluenzaA__AGK63015
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggaaaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucagacaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40477 - RNA, 1701 nt, Artificial Sequence
  hemagglutinin__InfluenzaA__AGK63017
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugacggcuuccaaaacaagaaaugggaccuuuuuguugaacgaagcaaagcccacagcaacuguuacccuuaugaugugccggauuaugccucccuuaggucccuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggaaggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40478 - RNA, 1701 nt, Artificial Sequence
  hemagglutinin__InfluenzaA__AGK63019
augaagacuaucauugcuuugagcuacauucuaugucugguuuucgcucaaaaacuuccuggaaaugacaacagcacggcaacgcugugccuuggacaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40479 - RNA, 1701 nt, Artificial Sequence
  hemagglutinin__InfluenzaA__AGK63021
augaagacuaucauugcuuugagcuacauucuaugucugguuuucgcucaagaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugacggcuuccaaaacaagaaaugggaccuuuuuguugaacgaagcaaagcccacagcaacuguuacccuuaugaugugccggauuaugccucccuuaggucccuaguugccucauccggcacacuggaguuuaacaaugaaagcuucaauuggacuggagucacucaaaacgggacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggaaggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuagagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuguguguugcuuuguugggguucaucaugugggccugccaaaaaggcaacauuaggugcaacauuugcauuuga

SEQ ID NO: 40480 - RNA, 1701 nt, Artificial Sequence
  hemagglutinin__InfluenzaA__AGK63025
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccucuuuauugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggaaaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40481 - RNA, 1701 nt, Artificial Sequence
  hemagglutinin__InfluenzaA__AGK63027
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacugauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40482 - RNA, 1701 nt, Artificial Sequence
  hemagglutinin__InfluenzaA__AGK63029
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugacggcuuccaaaacaagaaaugggaccuuuuuguugaacgaagcaaagcccacagcaacuguuacccuuaugaugugccggauuaugccucccuuaggucccuaguugccucauccggcacacuggaguuuaacaaugaaagcuucaauuggacuggagucacucaaaacgggacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuacaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggaaggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40483 - RNA, 1701 nt, Artificial Sequence
  hemagglutinin__InfluenzaA__AGK63031
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggggaaaacugcacacuaauagaugcucuauugggagacccucagugugauggcuuccaaaaaaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugauuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaacuccaucagauugaaaaagaauucucagaagucgaagggagaauucuggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40484 - RNA, 1701 nt, Artificial Sequence
  hemagglutinin__InfluenzaA__AGK63033
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuauuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggaaaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40485 - RNA, 1701 nt, Artificial Sequence
  hemagglutinin__InfluenzaA__AGK63035
augaagacuaucauugcuuugagcuacauucuaugucugguuuucgcucaaaaacuuccuggaaaugacaauagcacggcaacgcugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaacucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40486 - RNA, 1701 nt, Artificial Sequence
  hemagglutinin__InfluenzaA__AGK63037
augaagacuaucauugcuuugagcuacauucuaugucugguuuucgcucaagaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguaacccuuaugaugugccggauuaugccucccuuaggucacuaguugccucauccggcacacuggaguuuaacaaugaaagcuucaauuggacuggagucacucaaaacggaacaagcucugcuugcauaaggagauccaauaauaguuucuuuaguagauugaauugguugacccacuuaaacuucaaauacccagcauugaacgugaccaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcgcagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40487 - RNA, 1701 nt, Artificial Sequence
  hemagglutinin__InfluenzaA__AGK63039
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggggaaaacugcacacuaauagaugcucuauugggagacccucagugugauggcuuccaaaaaaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauuaggagaucuaauaauaguuucuuuaguagauugaauugguugacccacuuaaacuucaaauacccagcauugaacgugacuuugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuagcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggaaggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucaaauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugguccugccaaaaaggcaacauuaggugcaacauuugcauuuga

SEQ ID NO: 40488 - RNA, 1701 nt, Artificial Sequence
  hemagglutinin__InfluenzaA__AGK63041
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggccuccaaaacaagaaaugggaccuuauuguugaacgaagcaaagcccacagcuacuguuacccuuaugaugugccggauuaugccucccuuaggucacuaguugccucauccggcacacuggaguuuaacaacgaaagcuucaauuggacugaagucacucaaaacggaacaagcuccgcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggaaggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40489 - RNA, 1701 nt, Artificial Sequence
  hemagglutinin__InfluenzaA__AGK63043
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaagcacucugaaauuggcaacaggaaugagaaauguaccagagaaacaaacuagaggcauauuuggcgcaauagcggguuucauagaaaaugguugggaaggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40490 - RNA, 1701 nt, Artificial Sequence
  hemagglutinin__InfluenzaA__AGK63045
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaaaaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggaaaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcgcagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40491 - RNA, 1701 nt, Artificial Sequence
  hemagglutinin__InfluenzaA__AGK63047
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucgagaggggagaaugaacuauuacuggacacuaauagagccgggagacaaaauaacauucgaagcaacuggaaaucuagugguaccgagauaugcauucgcgauggaaagaaaugcuggaucugguauuaucauuucagauacaccaguccacgauugcaauacagcuugucagacacccgagggugcuauaaacaccagccucccauuucagaauauacauccgaucacaauugggaaauguccaaaauauguaaaaagcacaaaauugagacuggccacaggauugaggaaugucccgucuauucaaucuagaggccuguuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaagaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40492 - RNA, 1683 nt, Artificial Sequence
  hemagglutinin__InfluenzaA__AGK82158
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 40493 - RNA, 1683 nt, Artificial Sequence
  hemagglutinin__InfluenzaA__AGK84857
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacagggccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagauuacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 40494 - RNA, 1683 nt, Artificial Sequence
  hemagglutinin__InfluenzaA__AGK84860
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaugacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaggaagcucugaggcaaauacucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccuggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 40495 - RNA, 1683 nt, Artificial Sequence
  hemagglutinin__InfluenzaA__AGK84863
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaagacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 40496 - RNA, 1701 nt, Artificial Sequence
  hemagglutinin__InfluenzaA__AGL07713
augaaggcaauacuaguaguucugcuauauacauuugcaaccgcaaaugcagacacauuauguauagguuaccaugcgaacaauucaacagacacuguagacacaguacuagaaaagaauguaacaguaacacgcucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugaaauauuccccaagacagguucauggcccaaucaugacucgaacaaagguguaacggcagcauguccucaugcuggagcaaaaggcuucuacaaaaauuuaauauggcuaguugaaaaaggaaauucauacccaaagcucagcaaauccuacauuaaugauaaagggaaagaaguccucgugcuauggggcauucaccauccaucuacuacugcugaccaacaacgucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaacgagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuucuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40497 - RNA, 1701 nt, Artificial Sequence
  hemagglutinin__InfluenzaA__AGL09731
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauauccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauaagaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuauuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40498 - RNA, 1701 nt, Artificial Sequence
  hemagglutinin__InfluenzaA__AGL09732
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggggucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaaccagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40499 - RNA, 1701 nt, Artificial Sequence
  hemagglutinin__InfluenzaA__AGL09734
augaagacuaucauugcuuugagcuacauucuaugucugguuuucgcucaaaaauuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuauugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucugauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugauuuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40500 - RNA, 1701 nt, Artificial Sequence
  hemagglutinin__InfluenzaA__AGL09735
augaagaccaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauuaaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcucuguugggguucaucaugugggccugccaaaagggcaacauuaggugcaacauuagcauuuga

SEQ ID NO: 40501 - RNA, 1701 nt, Artificial Sequence
  hemagglutinin__InfluenzaA__AGL09736
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40502 - RNA, 1701 nt, Artificial Sequence; identical to SEQ ID NO: 40393
  hemagglutinin__InfluenzaA__AGL09737

SEQ ID NO: 40503 - RNA, 1701 nt, Artificial Sequence
  hemagglutinin__InfluenzaA__AGL09739
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcagcuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaaucaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaguuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40504 - RNA, 1701 nt, Artificial Sequence
  hemagglutinin__InfluenzaA__AGL09740
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauauggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaggggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40505 - RNA, 1701 nt, Artificial Sequence
  hemagglutinin__InfluenzaA__AGL09741
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaagucacuaaugcuacugagcugguucagaguuccucaacaggugaaauaugcgacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaacguaaacaggaucacauacggggccugccccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccguuuccagaucaagggaguugagcugaagucaggguacaaagauuggauccuauggauuuccuuugccauaucauguuuuuugcuuuguguugcuuuguugggauucaucaugugggccugccaaaaaggcaacauuaggugcaacauuugcauuuga

SEQ ID NO: 40506 - RNA, 1701 nt, Artificial Sequence
  hemagglutinin__InfluenzaA__AGL09742
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauauggggccugucccagauaugucaagcaaaacacucugaaauuggcaacaggaaugagaaauguaccagagacacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaggggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaggucaggguacaaagauuggauccuauggauuuccuuugccauaucauguuuuuugcuuuguguugcuuuguugggguucaucaugugggccugccaaaaaggcaacauuaggugcagcauuugcauuuga

SEQ ID NO: 40507 - RNA, 1701 nt, Artificial Sequence; identical to SEQ ID NO: 40362
  hemagglutinin__InfluenzaA__AGL09744

SEQ ID NO: 40508 - RNA, 1701 nt, Artificial Sequence
  hemagglutinin__InfluenzaA__AGL09745
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugccacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuaggggguacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcggaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaagaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggaugugggcaaugguuguuucaaaauauaccacaaaugugacaauaccugcauaggaucaaucagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggcaugccaaaagggcaacauuaggugcaacauuugcauuuga

SEQ ID NO: 40509 - RNA, 1701 nt, Artificial Sequence
  hemagglutinin__InfluenzaA__AGL09746
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcaggauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40510 - RNA, 1701 nt, Artificial Sequence
  hemagglutinin__InfluenzaA__AGL09747
augaagaccaucauugcuuugagcuacauucuaugucuaguuuucgcucaagaacuuccuggaaaugacgacagcacggcaacgcugugccuuggacaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugaggucagaugcacccauuggcaaaugcaauucugcaugcaucacuccaaauggaagcauucccaaugacaaaccauuccaaaauguaaacaggaucacauauggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaggggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40511 - RNA, 1701 nt, Artificial Sequence
  hemagglutinin__InfluenzaA__AGL09748
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagggucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40512 - RNA, 1701 nt, Artificial Sequence
  hemagglutinin__InfluenzaA__AGL09749
augaaggcaauacuaguaguucugcuguacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaaugggacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugccagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccguugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40513 - RNA, 1701 nt, Artificial Sequence
  hemagglutinin__InfluenzaA__AGL09750
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauccaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggauacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40514 - RNA, 1701 nt, Artificial Sequence
  hemagglutinin__InfluenzaA__AGL09751
augaagaccaucauugcuuugagcuacauucuaugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauauggggccugucccagauaugucaagcaaaacacucugaaauuggcaacaggaaugagaaaugugccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaggggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40515 - RNA, 1701 nt, Artificial Sequence
  hemagglutinin__InfluenzaA__AGL09753
augaagacuaucauugcuuugagcuacauucuaugucugguuuucgcucaaaaacuuccuggaaaugacaauagcacggcaacgcugugccuuggacaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaaggaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40516 - RNA, 1701 nt, Artificial Sequence
  hemagglutinin__InfluenzaA__AGL09754
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugccacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuauagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacagacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauccccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaguugagcugaagucaggguacaaagauuggauccuauggauuuccuuugccauaucaugucuuuugcuuuguguugcuuuguugggguucaucaugugggcaugccaaaagggcaacauuaggugcaacauuugcauuuga

SEQ ID NO: 40517 - RNA, 1701 nt, Artificial Sequence
  hemagglutinin__InfluenzaA__AGL09756
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaagcaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggaaaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40518 - RNA, 1701 nt, Artificial Sequence
  hemagglutinin__InfluenzaA__AGL09758
augaaggcaauacuaguaguuuugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaaauaugcaaacuaagagggguagccccauuacauuugggaaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaacuuaauauggcuaguuaaaaaaggaaauucauacccaaagcucagcaacuccuacauuaaugauaaagggaaagaaguccucgugcuauggggcauucaccauccaucuacuacugcugaucaacaaagucucuaucaaaaugcagauacauauguuuuuguggggacaucaagauacagcaagaaguucaagccggaaauagcaauaagacccaaagugagggaucaagaagggagaaugaacuauuacuggacacugguagagccgggagacaaaauaacauucgaagcaacuggaaaucuagugguaccgagauaugcauucgcaauggaaagaaaugcuggaucugguauuaucauuucagauacaacaguccacgauugcaauacaacuugucagacacccaagggugcuauaaacaccagccuaccauuucagaauauacauccgaucacaauuggaaaauguccaaaauacguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaucacgauucgaaugugaagaacuuauaugaaaagguaagaaaccaguuaaaaaacaaugccaaggaaauuggaaauggcugcuuugaauuuuaccacaaaugcgauaacaugugcauggaaaguguuaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 40519 - RNA, 1701 nt, Artificial Sequence
  hemagglutinin__InfluenzaA__AGL09760
augaagaccaucauugcugugagcuacauucuaugucuaguuuuugcucaagaacuuccuggaaaugacgacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40520 - RNA, 1701 nt, Artificial Sequence
  hemagglutinin__InfluenzaA__AGL09761
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcaccgggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40521 - RNA, 1701 nt, Artificial Sequence
  hemagglutinin__InfluenzaA__AGL09762
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacagugucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40522 - RNA, 1701 nt, Artificial Sequence
  hemagglutinin__InfluenzaA__AGL09763
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40523 - RNA, 1701 nt, Artificial Sequence
  hemagglutinin__InfluenzaA__AGL09764
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauaagaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40524 - RNA, 1701 nt, Artificial Sequence
  hemagglutinin__InfluenzaA__AGL09765
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugccuuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuaa

SEQ ID NO: 40525 - RNA, 1701 nt, Artificial Sequence
  hemagglutinin__InfluenzaA__AGL09766
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaauaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40526 - RNA, 1701 nt, Artificial Sequence
  hemagglutinin__InfluenzaA__AGL09767
augaagaccaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggggacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauuaaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40527 - RNA, 1701 nt, Artificial Sequence
  hemagglutinin__InfluenzaA__AGL09769
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauaagaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40528 - RNA, 1701 nt, Artificial Sequence
  hemagglutinin__InfluenzaA__AGL09770
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcguuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40529 - RNA, 1701 nt, Artificial Sequence
  hemagglutinin__InfluenzaA__AGL09771
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauauauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40530 - RNA, 1701 nt, Artificial Sequence
  hemagglutinin__InfluenzaA__AGL09772
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuaccccuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuuggggaguucaccacccggguacggacaaggaccaaaucuuccuguaugcucaagcagcaggaagaaucacaguaucuaccaaaagaagccaacaagcuguaauuccgaauaucggauccagacccaggguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaacggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguaugguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugauucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacuauguguacagagaugaagcauuaaacaaccgauuccagaucaagggaguugagcugaagucaggguacaaagauuggauccuauggauuuccuuugccacaucauguuuuuugcuuuguguugcuuuguugggguucaucaugugggccugccaaaaaggcaacauuaggugcaacauuugcauuuga

SEQ ID NO: 40531 - RNA, 1701 nt, Artificial Sequence
  hemagglutinin__InfluenzaA__AGL09773
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuaccccuaugaugugccggauuaugccucccuuaggucacuaguugccucauccggcacacuggaguuuaacaaugaaagcuucaauuggacugaagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuuggggaguucaccacccggguacggacaaggaccaaaucuuccuguaugcucaagcagcaggaagaaucacaguaucuaccaaaagaagccaacaagcuguaauuccgaauaucggauccagacccaggguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaacggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguaugguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugauucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacuauguguacagagaugaagcauuaaacaaccgauuccagaucaagggaguugagcugaagucaggguacaaagauuggauccuauggauuuccuuugccacaucauguuuuuugcuuuguguugcuuuguugggguucaucaugugggccugccaaaaaggcaacauuaggugcaacauuugcauuuga

SEQ ID NO: 40532 - RNA, 1701 nt, Artificial Sequence; identical to SEQ ID NO: 40530
  hemagglutinin__InfluenzaA__AGL09774

SEQ ID NO: 40533 - RNA, 1701 nt, Artificial Sequence
  hemagglutinin__InfluenzaA__AGL09775
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauauggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcucuguguugcuuuguugggguucaucaugugggccugccaaaagggcaacauuaggugcaacauuugcauuuga

SEQ ID NO: 40534 - RNA, 1701 nt, Artificial Sequence; identical to SEQ ID NO: 40530
  hemagglutinin__InfluenzaA__AGL09776

SEQ ID NO: 40535 - RNA, 1701 nt, Artificial Sequence; identical to SEQ ID NO: 40530
  hemagglutinin__InfluenzaA__AGL09777

SEQ ID NO: 40536 - RNA, 1701 nt, Artificial Sequence
  hemagglutinin__InfluenzaA__AGL09778
augaagacuaucauugcuuugagcuacauucuaugucugauuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacauuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugccgaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40537 - RNA, 1701 nt, Artificial Sequence
  hemagglutinin__InfluenzaA__AGL09779
augaagacuaucauugcuuugagcuacauucuaugucugguuuucgcucaaaaacuuccuggaaauaacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguccaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40538 - RNA, 1701 nt, Artificial Sequence
  hemagglutinin__InfluenzaA__AGL09780
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuugacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguccaccacccagguacggacaaggaccaaaucucccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40539 - RNA, 1701 nt, Artificial Sequence
  hemagglutinin__InfluenzaA__AGL09781
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauaagaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcgggcuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40540 - RNA, 1701 nt, Artificial Sequence
  hemagglutinin__InfluenzaA__AGL09782
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauauuccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggaggggaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40541 - RNA, 1701 nt, Artificial Sequence
  hemagglutinin__InfluenzaA__AGL09783
augaagacuaucauugcuuugagcuacauucuaugucugguuuucgcucaaaaacucccuggaaaugacaauagcacggcaacgcugugccuugggcaccaugcaguaccaaacggaacgguagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccccagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauuggcugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcaggauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaacucagaaccuugagaaauauguugaggacacuaaaauagaucucuggucauacaaugcggagcuucuuguugcccuggagaaccaacauacaauugaucuaacugacucagaaaugaacaaacuguuugaaaaaacaaagaaacaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagauuaagggaguugagcugaagucaggguacaaagauuggauccuauggauuuccuuugccauaucauguuuuuugcuuuguguuguuuuguugggguucaucaugugggccugccaaaagggcaacauuaggugcaacauuugcauuuga

SEQ ID NO: 40542 - RNA, 1701 nt, Artificial Sequence; identical to SEQ ID NO: 40372
  hemagglutinin__InfluenzaA__AGL09785

SEQ ID NO: 40543 - RNA, 1701 nt, Artificial Sequence
  hemagglutinin__InfluenzaA__AGL09786
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuugucgaacgaagcaaagccuacagcaacuguuacccuuaugaugugccggauuaugccucccuuaggucacuaguugccucauccggcacacuggaguuugacaaugaaagcuucaauugggcuggagucacucaaaacggaacaaguucugcuugcauaaggggaucuaagaguaguuucuuuaguagauuaaauugguugacccacuuaaacuucaaauacccagcauugaacgugacuaugccaaacaaugagcaauuugacaaauuguacauuugggggguccaccacccagguacggacaaggaccaaaucucccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggugcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40544 - RNA, 1701 nt, Artificial Sequence
  hemagglutinin__InfluenzaA__AGL09787
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacguucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaacauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 40545 - RNA, 1701 nt, Artificial Sequence; identical to SEQ ID NO: 40544
  hemagglutinin__InfluenzaA__AGL09788

SEQ ID NO: 40546 - RNA, 1701 nt, Artificial Sequence; identical to SEQ ID NO: 40544
  hemagglutinin__InfluenzaA__AGL09789

SEQ ID NO: 40547 - RNA, 1701 nt, Artificial Sequence
  hemagglutinin__InfluenzaA__AGL09790
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguccaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40548 - RNA, 1701 nt, Artificial Sequence
  hemagglutinin__InfluenzaA__AGL09791
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacaugacuaugccaaacaaugaacaauuugacaaauuguacauuugggggguucaccacccggguacggacaaggaccaaaucucccuguaugcucaaucaucaggaagaaucacaguaucuaccaaaagaagccaacaagcuguaaucccaaauaucggaucuagacccagaauaaggaauauuccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcaggcuucauagaaaaugguugggaggggaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40549 - RNA, 1701 nt, Artificial Sequence
  hemagglutinin__InfluenzaA__AGL09792
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauccaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40550 - RNA, 1701 nt, Artificial Sequence
  hemagglutinin__InfluenzaA__AGL09794
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagauacacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40551 - RNA, 1701 nt, Artificial Sequence
  hemagglutinin__InfluenzaA__AGL09795
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40552 - RNA, 1701 nt, Artificial Sequence
  hemagglutinin__InfluenzaA__AGL09797
augaagacuaucauugcuuugagcuacauucuaugucugguuuucucucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40553 - RNA, 1701 nt, Artificial Sequence
  hemagglutinin__InfluenzaA__AGL09798
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauuuugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacuauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40554 - RNA, 1701 nt, Artificial Sequence; identical to SEQ ID NO: 40552
  hemagglutinin__InfluenzaA__AGL09799

SEQ ID NO: 40555 - RNA, 1701 nt, Artificial Sequence
  hemagglutinin__InfluenzaA__AGL09800
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucuuccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuucaucagauugaaaaagaauucucagaaguagaagggagaauucaggaccucgagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40556 - RNA, 1701 nt, Artificial Sequence
  hemagglutinin__InfluenzaA__AGL09801
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccucaggucacuaguugcuucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40557 - RNA, 1701 nt, Artificial Sequence
  hemagglutinin__InfluenzaA__AGL09802
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccucaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccagguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacccaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40558 - RNA, 1701 nt, Artificial Sequence
  hemagglutinin__InfluenzaA__AGL09803
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccucaggucacuaguugccucauccggcacacuggaauuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagaacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40559 - RNA, 1701 nt, Artificial Sequence; identical to SEQ ID NO: 40397
  hemagglutinin__InfluenzaA__AGL09804

SEQ ID NO: 40560 - RNA, 1701 nt, Artificial Sequence
  hemagglutinin__InfluenzaA__AGL09805
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40561 - RNA, 1701 nt, Artificial Sequence; identical to SEQ ID NO: 40530
  hemagglutinin__InfluenzaA__AGL09806

SEQ ID NO: 40562 - RNA, 1701 nt, Artificial Sequence; identical to SEQ ID NO: 40560
  hemagglutinin__InfluenzaA__AGL09807

SEQ ID NO: 40563 - RNA, 1701 nt, Artificial Sequence
  hemagglutinin__InfluenzaA__AGL09808
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaaugucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40564 - RNA, 1701 nt, Artificial Sequence
  hemagglutinin__InfluenzaA__AGL09809
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaaaacaaguucauggccaaaucaugacucgaacaaagguguaacggcagcauguccucaugcuggagcaaaaggcuucuacaaaaauuuaauauggcuaguuaaaaaaggaaauucauacccaaagcucagcauauccuacauuaaugacaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcuggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugccgcuaguucauugguacugguagucucccugggggcaaucaguuuuuggaugugcucuaaugggucucuacaguguagaauauguauuuaa

SEQ ID NO: 40565 - RNA, 1701 nt, Artificial Sequence
  hemagglutinin__InfluenzaA__AGL09810
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggagaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuagcaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacgggaccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcaugggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40566 - RNA, 1701 nt, Artificial Sequence; identical to SEQ ID NO: 40371
  hemagglutinin__InfluenzaA__AGL09811

SEQ ID NO: 40567 - RNA, 1701 nt, Artificial Sequence
  hemagglutinin__InfluenzaA__AGL09812
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaagauaagaaaugggaccuuuuuguugaacgaagcaaagccuacagcaacuguuacccuuaugaugugccggauuaugccucccuuaggucacuaguugccucuuccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccucgagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40568 - RNA, 1701 nt, Artificial Sequence
  hemagglutinin__InfluenzaA__AGL09813
augaagaccaucauugcuuugagcuacauucuaugucuaguuuuugcucaagaacuuccuggaaaugacgacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccaggguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40569 - RNA, 1701 nt, Artificial Sequence; identical to SEQ ID NO: 40393
  hemagglutinin__InfluenzaA__AGL09814

SEQ ID NO: 40570 - RNA, 1701 nt, Artificial Sequence
  hemagglutinin__InfluenzaA__AGL09815
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaguaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40571 - RNA, 1701 nt, Artificial Sequence; identical to SEQ ID NO: 40391
  hemagglutinin__InfluenzaA__AGL09816

SEQ ID NO: 40572 - RNA, 1701 nt, Artificial Sequence
  hemagglutinin__InfluenzaA__AGL09817
augaaaaccaucauugcuuugagcuacauucuuugucuaguuuucgcucaagaacuuccuggaaaugacgacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccccaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacagugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaaaggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40573 - RNA, 1701 nt, Artificial Sequence; identical to SEQ ID NO: 40393
  hemagglutinin__InfluenzaA__AGL09818

SEQ ID NO: 40574 - RNA, 1701 nt, Artificial Sequence
  hemagglutinin__InfluenzaA__AGL09819
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucuuccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccucgagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40575 - RNA, 1701 nt, Artificial Sequence
  hemagglutinin__InfluenzaA__AGL09820
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacagugucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaauagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40576 - RNA, 1701 nt, Artificial Sequence
  hemagglutinin__InfluenzaA__AGL09821
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguguacagggaugaagcauuaaacaaccgguuccagaucaagggaauugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40577 - RNA, 1701 nt, Artificial Sequence
  hemagglutinin__InfluenzaA__AGL09822
augaagacuaucauugcuuugagcuacauucuaugccugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugaggucagaugcacccauugguaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40578 - RNA, 1701 nt, Artificial Sequence
  hemagglutinin__InfluenzaA__AGL09823
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 40579 - RNA, 1701 nt, Artificial Sequence
  hemagglutinin__InfluenzaA__AGL09824
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugcaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggaacaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaagggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 40580 - RNA, 1701 nt, Artificial Sequence; identical to SEQ ID NO: 40522
  hemagglutinin__InfluenzaA__AGL09825

SEQ ID NO: 40581 - RNA, 1701 nt, Artificial Sequence; identical to SEQ ID NO: 40579
  hemagglutinin__InfluenzaA__AGL09826

SEQ ID NO: 40582 - RNA, 1701 nt, Artificial Sequence
  hemagglutinin__InfluenzaA__AGL09827
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugcuucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40583 - RNA, 1701 nt, Artificial Sequence
  hemagglutinin__InfluenzaA__AGL09828
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuacaggcaucaaaauucugagggaagaggacaagcagcagaucucaaaagcacucaagcagcaaucgaucaaaucaaugggaagcugaaucgauugaucgggaaaaccaacgagaaauuccaucagauugagaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40584 - RNA, 1701 nt, Artificial Sequence
  hemagglutinin__InfluenzaA__AGL09829
augaagacuaucauugcuuugagcuacauucuaugucugguuuucgcucaaaaacuuccuggaaaugacaauagcacggcaacgcugugccuugggcaccaugcaguaccaaacggaacaauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacacugaaauuggcaacaggaaugcgaaauguaccagagaaacaaacuagaggaauauuuggcgcaauagcggguuucauagaaaaugguugggagggaaugguggaugguugguacgguuucaggcaucaaaauucugagggaagaggacaagcagcagaucucgaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40585 - RNA, 1701 nt, Artificial Sequence
  hemagglutinin__InfluenzaA__AGL09830
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacuaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaucuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40586 - RNA, 1701 nt, Artificial Sequence
  hemagglutinin__InfluenzaA__AGL09831
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauaagaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaaacugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40587 - RNA, 1701 nt, Artificial Sequence
  hemagglutinin__InfluenzaA__AGL09832
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacucaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaacaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40588 - RNA, 1701 nt, Artificial Sequence
  hemagglutinin__InfluenzaA__AGL09833
augaagacuaucauugcuuugagcuacauucuaugucugguuuucgcucaaaaacuuccuggaaaugacaauagcacggcaacgcugugccuuggacaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaauggcuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40589 - RNA, 1701 nt, Artificial Sequence
  hemagglutinin__InfluenzaA__AGL09881
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggagcaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40590 - RNA, 1701 nt, Artificial Sequence
  hemagglutinin__InfluenzaA__AGL09882
augaagaccaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaaucagaaauggaacuuaugaccacaauguguacagggaugaagcauuaaacaaccgguuccagaucaagggaguugagcuuaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 40591 - RNA, 1701 nt, Artificial Sequence
  hemagglutinin__InfluenzaA__AGL09883
augaagaccaucauugcuuugagcuacauucuaugucuaguuuuugcucaagaacuuccuggaaaugacgacagcacggcaacgcugugccuugggcaccaugcagugccaaacggaacgauagugaaaacaaucacgaaugaccaaauugaaguuacuaaugcuacugaacugguucaaaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugaggaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40592 - RNA, 1701 nt, Artificial Sequence
  hemagglutinin__InfluenzaA__AGL09884
augaagaccaucauugcuuugagcuacauucuaugucuaguuuuugcucaagaacuuccuggaaaugacgacagcacggcaacgcugugccuugggcaccaugcagugccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 40593 - RNA, 1683 nt, Artificial Sequence
  hemagglutinin__InfluenzaA__AGL44438
augaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaaaggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 40594 - RNA, 1701 nt, Artificial Sequence
  hemagglutinin__InfluenzaA__AGN69267
augaaggcaauacugguagucuugcuauauacauuuacaaccggaaaugcagacacauuauguauagguuaccaugcaaauaauucaacugacacuguugacacaguacuagaaaagaauguaacaguaacacacucuguuaaccuucuagaagacagacauaacgggaaacuauguaaacuaagagggguagccccauugcauuuggguaaauguaacauugcuggauggcuccugggaaacccagagugugaauuacuauucacagcaagcucauggucuuacauuguggaaacaucuaauucagacaaugggacauguuacccaggagauuucaucaauuaugaagagcuaagagagcaguugagcucagugucaucauuugaaagauuugagauauuccccaaggcaaguucauggcccaaucaugaaacgaacagaggugugacggcagcauguccuuaugcuggagcaaacagcuucuacagaaauuuaauauggcugguaaaaaaaggaaauucauacccaaagcucagcaaauccuauauuaacaauaaggagaaggaaguccucgugcuauggggcauucaccauccaccuaccaguacugaccaacaaagucucuaccagaaugcagaugccuauguuuuuguggggucaucaaaauacagcaagaaauucaagccagaaauagcaacaagacccaaggugagaggucaagcagggagaaugaacuauuacuggacacuaguagagccuggagacacaauaacauucgaagcaacuggaaaucuagugguaccaagauaugccuucgcaaugaaaagagguucuggaucugguauuaucauuucagauacaccaguccacgauuguaauacgacuugucaaacacccaaaggugcuauaaacaccagccuuccauuucagaauauacauccagucacaauuggagaauguccaaaauaugucaaaagcacaaaauugagaauggcuacaggauuaaggaauaucccgucuauucaaucuagaggccuguuuggagccauugcuggcuuuauugaggggggauggacaggaaugauagauggaugguacgguuaucaccaucaaaaugagcagggaucaggauaugcagccgaccgaaagagcacacagaaugccauugacgggaucacuaacaaaguaaauucuguuauugaaaagaugaacacacaauucacagcaguggguaaagaauucaaccaccuggaaaaaagaauagagaauuuaaacaaaaagguugaugauggucuucuggauguuuggacuuacaaugccgaacuguugguucuauuggaaaaugaaagaacuuuggauuaucacgauucaaaugugaagaaccuauaugagaaaguaagaagccagcuaaaaaacaaugccaaggaaauuggaaauggcugcuuugaauuuuaccacaaaugugaugacacgugcauggagagcgucaaaaaugggacuuaugauuacccaaaauacucagaagaagcaaaacuaaacagagaggagauagaugggguaaagcuggaaucaacaaggauuuaccagauuuuggcgaucuauucaacugucgccaguucauugguacuguuagucucccugggggcaaucaguuucuggaugugcuccaaugggucuuuacagugcagaauauguauuuaa

SEQ ID NO: 40595 - RNA, 1701 nt, Artificial Sequence
  hemagglutinin__InfluenzaA__AGN69278
augaaggcaauacuaguagucuugcuauauacauuuacaaccgcaaaugcagacacauuauguauagguuaccaugcaaauaauucaacugacacuguugacacaguacuagaaaagaauguaacaguaacacacucuguuaaccuucuagaagacagacauaacgggaaacuauguaaacuaagagggguagccccauugcauuuggguaaauguaacauugcuggauggcuccugggaaacccagagugugaauuacuauucacagcaagcucauggucuuacauuguggaaacaucuaauucagacaaugggacauguuacccaggagauuucaucaauuaugaagagcuaagagagcaguugagcucagugucaucauuugaaagauuugagauauuccccaaggcaaguucauggcccaaucaugaaccgaacagaggugugacggcagcauguccuuaugcuggagcaaacagcuucuacagaaauuuaauauggcugguaaaaaaaggaaauucauacccaaagcucagcaaauccuauauuaacaauaaggagaaggaaguccucgugcuauggggaauucaccauccaccuaccaguacugaccaacaaagucucuaccagaaugcagaugccuauguuuuuguggggucaucaaaauacaacaagaaauucaagccagaaauagcaacaagacccaaggugagaggucaagcagggagaaugaacuauuacuggacacuaguagagccuggagacacaauaacauucgaagcaacuggaaaucuagugguaccaagauaugccuucgcaaugaaaagagguucuggaucugguauuaucauuucagauacaccaguccacgauuguaauacgacuugucaaacacccaaaggugcuauaaacaccagccuuccauuucagaauauacauccagucacaauuggagaauguccaaaauaugucaaaagcacaaaauugagaauggcuacaggauuaaggaauaucccgucuauucaaucuagaggccuguuuggagccauugcuggcuuuauugaggggggauggacaggaaugauagauggaugguacgguuaucaccaucaaaaugagcagggaucaggauaugcagccgaccgaaagagcacacagaaugccauugacgggaucacuaacaaaguaaauucuguuauugaaaagaugaacacacaauucacagcaguggguaaagaauucaaccaccuggaaaaaagaauagagaauuuaaacaaaaagguugaugauggucuucuggauguuuggacuuacaaugccgaacuguugguucuauuggaaaaugaaagaacuuuggauuaucacgauucaaaugugaagaaccuauaugagaaaguaagaagccagcuaaaaaacaaugccaaggaaauuggaaauggcugcuuugaauuuuaccacaaaugugaugacacgugcauggagagcgucaaaaaugggacuuaugauuacccaaaauacucagaagaagcaaaacuaaacagagaggagauagaugggguaaagcuggaaucaacaaggauuuaccagauuuuggcgaucuauucaacugucgccaguucauugguacuguuagucucccugggggcaaucaguuucuggaugugcuccaaugggucuuuacagugcagaauauguauuuaa

SEQ ID NO: 40596 - RNA, 1701 nt, Artificial Sequence
  hemagglutinin__InfluenzaA__AGN69302
auggaagccaaacuauuuguauuauucugugcauucacugcacugaaagcugacaccauuuguguaggcuaccaugccaacaauuccacagacacugucgacacaauacuggagaaaaaugugacuguuacccauucaguuaauuuacuggaaaacagccauaaugggaaacucugcagccugaauggaaagauccccuuacaacuggggaacugcaacguagcaggauggauccuuggcaacccaaaaugugacuuacugcucacagcaaauucguggucuuacauaauagagacuucaaauucaaaagauggagcaugcuaccccggagaauucgcugauuaugaagaguuaaaggagcaguugaguacaguuucuucauuugaaagauuugaaauuuucccaaaggcaaccucauggccaaaccaugacacaaccagagguaccacaguugcaugcucccacucuggagccaacaguuuuuaucggaauuuacuauggauaguaaagaaaggaaacuccuauccuaagcucagcaagucauacacaaacaauaagggaaaggaagugcuuguaauuuggggagugcaccacccuccgaccgacagugaccaacaaacccucuaccagaauaaucauacauauguuucaguuggaucaucaaaauacuacaaaagguucacaccagaaauaguagcaagaccuaaagucagggaacaagcaggcagaaugaauuauuacuggacacuguuagaucaaggggacaccauaacuuuugaagccacugggaauuuaauagcaccauggcacgcauuugcauugaaaaaaggcucuaguucuggaauuaugaugucggaugcucagguucacaauugcacuacaaagugccaaacuccccauggggccuugaaaggcaaucuuccauuucagaauguacaucccgucacuauuggagaaugccccaaauauguuaaaagcacccaacugagaauggcaacaggacuaaggaauauacccucuauucaauccagaggacuuuucggggcaauugccggauucauugaaggaggauggacaggaaugguagauggaugguauggauaccaccaucaaaaugagcagggaucugguuacgcagcagaucagaagagcacacaaauugcaauugauggaauaagcaacaaagugaacucaguaauugaaaaaaugaacauucaauuuacuucagugggcaaggaguucaauagucuagagaaaaggauggaaaauuugaauaagaagguugaugauggguuuuuggauguauggacauauaacgcugaguugcucauucuacucgagaaugaaaggacucuagauuuccaugaccuuaacguaaaaaauuuauaugaaaaggucaaaucacaacuaaggaacaaugccaaggaaaucggaaauggcugcuuugaguucuaucacaaaugugauaaugagugcauggaaagcguaaagaauggcacauacaauuaucccaaauauucagaagaauccaaguugaauagggaggaaauagauggugugaaacuagaaucaaugggaauucaccagauuuuggcgaucuacuccacagucgccaguucccuggucuuauuagucucccugggggcaaucagcuucuggauguguucuaaugggucauugcaaugcagaguaugcauuuaa

SEQ ID NO: 40597 - RNA, 1701 nt, Artificial Sequence
  hemagglutinin__InfluenzaA__AGN69314
auggaagccaaacuauuuguauuauucugugcauucacugcacugaaagcugacaccauuuguguaggcuaccaugccaacaauuccacagacacugucgacacaauacuggagaaaaaugugacuguuacccauucaguuaauuuacuggaaaacagccauaauggaaaacucugcagccugaauggaaagauccccuuacaacuggggaacugcaacguagcaggauggauccuuggcaacccaaaaugugacuuacugcucacagcaaauucguggucuuacauaauagagacuucaaauucaaaagauggagcaugcuaccccggagaauucgcugauuaugaagaguuaaaggagcaguugaguacaguuucuucauuugaaagauuugaaauuuucccaaaggcaaccucauggccaaaccaugacacaaccagagguaccacaguugcaugcucccacucuggagccaacaguuuuuaucggaauuuacuauggauaguaaagaaaggaaacuccuauccuaagcucagcaagucauacacaaacaauaagggaaaggaagugcuuguaauuuggggagugcaccacccuccgaccgacagugaccaacaaacccucuaccagaauaaucauacauauguuucaguuggaucaucaaaauacuacaaaagguucacaccagaaauaguagcaagaccuaaagucagggaacaagcaggcagaaugaauuauuacuggacacuguuagaucaaggggacaccauaacuuuugaagccacugggaauuuaauagcaccauggcacgcauuugcauugaaaaaaggcucuaguucuggaauuaugaugucggaugcucagguucacaauugcacuacaaagugccaaacuccccauggggccuugaaaggcaaucuuccauuucagaauguacaucccgucacuauuggagaaugccccaaauauguuaaaagcacccaacugagaauggcaacaggacuaaggaauauacccucuauucaauccagaggacuuuucggggcaauugccggauucauugaaggaggauggacaggaaugguagauggaugguauggauaccaccaucaaaaugagcagggaucugguuacgcagcagaucagaagagcacacaaauugcaauugauggaauaagcaacaaagugaacucaguaauugaaaaaaugaacauucaauuuacuucagugggcaaggaguucaauagucuagagaaaaggauggaaaauuugaauaagaagguugaugauggguuuuuggauguauggacauauaacgcugaguugcucauucuacucgagaaugaaaggacucuagauuuccaugaccuuaacguaaaaaauuuauaugaaaaggucaaaucacaacuaaggaacaaugccaaggaaaucggaaauggcugcuuugaguucuaucacaaaugugauaaugagugcauggaaagcguaaagaauggcacauacaauuaucccaaauauucagaagaauccaaguugaauagggaggaaauagauggugugaaacuagaaucaaugggaauucaccagauuuuggcgaucuacuccacagucgccaguucccuggucuuauuagucucccugggggcaaucagcuucuggauguguucuaaugggucauugcaaugcagaguaugcauuuaa

SEQ ID NO: 40598 - RNA, 1701 nt, Artificial Sequence; identical to SEQ ID NO: 40596
  hemagglutinin__InfluenzaA__AGN69326

SEQ ID NO: 40599 - RNA, 1701 nt, Artificial Sequence
  hemagglutinin__InfluenzaA__AGN69338
auggaagcaaaauuauuuguauuguucugugcauucacugcacuaaaagcugacaccauuuguguaggcuaccaugccaacaauuccacagacacugucgacacaauacuggagaaaaaugugacuguuacccauucaguuaauuuacuggaaaacagccauaaugggaaacucugcagccugaauggaaagauccccuuacaacuggggaacugcaacguagcaggauggauccuuggcaacccaaaaugugacuugcugcucacagcgaauucguggucuuacauaauagagacuucaaauucaaaaaauggagcaugcuaccccggagaauucgcugauuaugaagaguuaaaggagcagcugaguacaguuucuucauuugaaagauuugaaauuuucccaaaggcaaccucauggccaaaccaugauaccaccagagguaccacaguugcaugcucccacucuggagccaacagcuuuuaucggaauuuacuauggauaguaaagaaaggaaacuccuauccuaagcucagcaagucauacacaaacaauaagggaaaggaagugcuuguaauuuggggagugcaccacccuccgaccgacagugaccaacaaacccucuaccagaauaaucauacauauguuucaguuggaucaucaaaauacuacaaaagguucacaccagaaauaguagcaagaccuaaagucagagaacaagcaggcagaaugaauuauuacuggacacuguuacaucaaggggacaccauaacuuuugaagccacugggaauuuaauagcaccauggcacgcauuugcauugaaugaaggcucuaguucuggaauuaugaggucggaugcucagguucacaauugcacuacaaagugccaaacuccccauggggccuugaaaggcaaucuuccuuuucagaauguacaucccgucacuauuggagaaugccccaaauauguuaaaagcacccaacugagaauggcaacaggacuaaggaauauccccucuauucaauccagaggacuuuucggggcaauugccggauucauugaaggaggauggacaggaaugguagauggaugguauggauaucaccaucgaaaugagcagggaucugguuacgcagcagaucagaaaagcacacaaauugcaauugaugggauaaguaacaaagugaacucagugauugaaaaaaugaacauucaauuuacuucagugggcaaggagugcaauagucuagagaaaaggauggaaaauuugaauaagaagguugaugauggguuuuuggauguauggacauauaacgcugaguugcucauuuuacucgagaaugaaaggacucuagauuuccaugaccuuaacguaaaaaauuuauaugaaaaggucaaaucacaacuaaggaacaaugccaaggaaaucggaaauggcugcuuugaguucuaucacaaaugugauaaugagugcauggaaagcguaaagaauggcacauacaauuaucccaaauauucagaagaauccaaauuaaauagggaggaaauagauggugugaaacuagaaucaaugggaauucaccagauuuuggcgaucuacuccacagucgccaguucccuggucuuauuagucucccugggggcaaucagcuucuggauguguucuaaugggucauugcaaugcagaguaugcauuuaa

SEQ ID NO: 40600 - RNA, 1701 nt, Artificial Sequence
  hemagglutinin__InfluenzaA__AGO00265
augaaggcaagacuacugguccuguuaugugcaauugcagcuacagaugcagacacaauauguauaggcuaccaugcgaacaacucaaccgacacuguugacacaauacucgaaaagaaugugacagugacacacucugucaaccugcucgaagacagccacaacgggaaauuauguagauuaaaagggauagccccacuacaauuggggaaauguaacauugccggauggaucuugggaaauccagaaugcgaaucacugcuuucagagagaucaugguccuacauuguagaaacaccaaacucugagaauggaacauguuacccaggagauuucaucgacuaugaggaacugagagagcaauugagcucaguaacaucauucgaaagauucgaaauauuccccaaggaaaccucauggcccaaacacaacacaaccaaaggaguaacggcagcaugcucccaugcgggaaaaugcaguuuuuacagaaauuugcuauggcugacggagaaggauggcucauacccgaaucugaauaauuccuaugugaacaagaaagggaaagaaguccuuguacuaugggguguucaucacccguccaacauaaaggaucaacagacccucuaucagaaagaaaaugcuuaugucucuguagugucuucaaauuauaacaggagauucaccccggaaauagcagaaagacccaaaguaagaggucaagcagggagaaugaacuauuacuggaccuugcuagaacccggagacacaauaauauuugaggcaaauggaaaucuaauagcgccaugguaugcuuuugcacugaguagaggcuuugggucaggcaucaucaccucaaaugcaucaaugcaugaguguaacacgaagugucaaacaccccagggagcuauaaacagcagucucccuuuccagaauauacacccagucacaauaggagagugcccaaaauaugucaggaguaccaaauugaggaugguuacaggacuaaggaacaucccauccauucaauccagaggucuauuuggagccauugccgguuucauugaagggggguggacuggaaugauagauggaugguaugguuaucaucaucagaaugaacagggaucaggcuaugcugcggaucaaaaaagcacacaaaaugccauuaacgggauuacaaacaaggugaacucuguuaucgagaaaaugaacacucaauucacagcuguggguaaagaauucaacaacuuagaaaaaaggauggaaaaccuaaauaaaaaaguugaugauggauuucuggacauuuggacauauaaugcagaauuguugguucuacuggaaaaugaaaggacucuggauuuccaugacucaaaugugaagaaucuguaugaaaaaguaaaaagccaauuaaggaauaaugccaaagaaauaggaaacggguguuuugaguucuaccacaaguguaacaaugaaugcauggaaaguguaaaaaauggaacuuaugauuauccaaaauauucagaagaaucaaaguugaacagggaaaaaauagauggagugaaauuggaaucaaugggggucuaucagauuuuggcgaucuacucaacugucgccaguucacuggugcuucuggucucccugggggcaaucagcuucuggauguguucuaaugggucuuugcagugcagaauaugcaucuga

SEQ ID NO: 40601 - RNA, 1701 nt, Artificial Sequence
  hemagglutinin__InfluenzaA__AGO00277
augaaagcaaaacuacugauccuguuaugugcacuuucagccacagaugcagacacaauauguauaggcuaccaugcgaacaacucaaccgacacuguugacacaguacucgaaaagaaugugacagugacacacucuguaaaccuacucgaagacagccacaacgggaaauuaugcagauuaaaaggaauagccccacuacaauuggggaaauguaacauugccggauggaucuuaggaaacccagaaugcgaaucacugcuuucuaagagaucaugguccuacauugcagaaacaccaaacucugagaauggaacauguuacccaggagauuucgccgacuaugaggaacugagggagcaauugagcucaguaucaucauucgagagauucgaaauauuccccaaggaaagaucauggcccaaccacaacauaaacauaggaguaacggcagcaugcucccaugcggggaaaagcaguuuuuacaaaaauuugcucuggcugacggagaaagauggcucauacccaaaucugaacaaguccuaugugaacaagaaagagaaagaaguccuuguacuaugggguguucaucacccgucuaacauagagaaucaaaagacccucuaucggaaagaaaaugcuuaugucucuguagugucuucaaauuauaacaggagauucaccccggaaauagcagaaagacccaaaguaagaggucaagcagggagaaugaacuauuacuggacuuugcuagaacccggagacacaauaauauuugaggcaaauggaaaucuaauagcgccaugguaugcuuucgcacuaaguagaggccuuggaucaggaaucaucaccucaaacgcaucaauggaugaaugugacacgaagugucaaacaccccagggagcuauaaacaguagucucccuuuccagaauauacacccauucacaauaggagagugcccaaaauacgucaggaguaccaaauugaggaugguuacaggacuaaggaacaucccauccauucaauccagaggucuguuuggagccauugccgguuucauugaagggggaugggcuggaaugauagauggaugguaugguuaccaucaucagaaugaacagggaucuggcuaugcugcggaucaaaaaagcacacaaaaugccauuaacgggauuacaaauaagguaaacucuguuaucgagaaaaugaacacucaauucacugcuguggguaaagaauucaacaaauuagaaaaaagaauggaaaacuuaaauaaaaaaguugaugauggauuucuggacauuuggacauauaaugcagaauuguugguucuacuggaaaacgaaaggacuuuggauuuccaugacucaaaugugaagaaucuguaugagaaaguaaaaaaccaauuaaggaauaaugccaaagaaauaggaaacggguguuuugaguucuaccacaaguguaacaaugaaugcauggaaaguguaaaaaauggaacuuaugauuacccaaaauauucagaggaaucaaaguuaaacagggaaaaaauugauggagugaaauuggaaucaaugggggucuaucagauucuggcgaucuacucaacugucgccaguucacuggugcuucuggucucccugggggcaaucagcuucuggauguguucuaaugggucuuugcagugcagaauaugcaucuga

SEQ ID NO: 40602 - RNA, 1701 nt, Artificial Sequence
  hemagglutinin__InfluenzaA__AGO00289
augaaagcaagacuacugauccuguuaugugcacuuucagcuacagaugcagacacaauauguauaggcuaccaugcgaacaauucaaccgacacuguugacacaguacucgaaaagaaugugacagugacacacucuguaaaccuacucgaagacagccacaacgggaaauuaugcagauuaaaaggaauagccccacuacaauuggggaaauguaacauugccggauggaucuugggaaacccagaaugcgaaucauugcucucuaauagaucaugguccuacauugcagaaacaccaaacucugagaauggaauauguuacccaggagauuucgccgacuaugaggaacugagggagcaauugagcucaguaucaucauucgagagauucgaaauauuccccaaggaaagcucauggcccaaacacaacauaaccagaggaguaacgguagcaugcucccacgcgaagaaaagcaguuuuuacaaaaauuugcucuggcuaacggaggcaaauggcuuauacccaagucugagcaaguccuaugugaacgacagagagaaagaaguccuugugcuaugggguguucaucacccgucuaacauagaggaucaaaggacccucuaucggaaagaaaaugcuuaugucucuguggugucuucaaauuauaacaggagauucaccccggaaauagcagaaagacccaaaguaagaggucaaccagggagaaugaacuauuacuggacuuugcuagaacccggagacaaaauaauauuugaggcaaauggaaaccuaauagcgccaugguaugcuuucgcacugaguagaggcccuggaucaggaaucaucaccuccaacgcaucaauggaugaaugugacacgaagugucaaacaccccagggagccauaaacaguagccucccuuuucagaacauacacccagucacaauaggagagugcccaaaauaugucaggaguaccaaauugaggaugguuacaggacuaaggaacaucccauccauucaauccagaggucuguuuggagccauugccgguuucauugaagggggauggacuggaaugguggauggaugguaugguuaccaucaucagaaugagcagggaucuggcuaugcugcggaccaaaaaagcacacaaaaugccauuaacgggauuacaaauaaggugaacucuguuaucgagaaaaugaacacucaauucacagcuguggguaaagaguucaacaaauuggaaaaaagaauggaaaacuuaaauaaaaaaguugaugauggauuucuggacauuuggacauauaaugcagaauuauugguucuacuggaaaaugaaaggacuuuggauuuccaugacucaaaugugaagaaucuguaugagaaaguaaaaaaccaauugagaaauaaugcaaaggaaauaggaaacggguguuuugaguucuaccacaagugugacaaugaaugcauggaaaguguaaaaaauggaacuuaugauuacccaaaguauucagaggaaucaaaguuaaacagggcaaaaauugauggaguaaaacuggaaucaaugggggucuaucagauucuggcgaucuacucaacugucgccaguucacuggugcuucuggucucccugggggcaaucagcuuuuggauguguuccaaugggucuuugcaaugcagaauaugcaucuga

SEQ ID NO: 40603 - RNA, 1698 nt, Artificial Sequence
  hemagglutinin__InfluenzaA__AGO00301
augaaagcaaaacuacugauccuguuaugugcacuuuccgcuacagaugcagacacaauauguauaggcuaccaugcaaacaauucaaccgacacuguugacacaguacucgagaagaaugugacagugacacacucuguaaaccuacucgaagacagccacaaugggaaauuaugcagauuaaaaggaaaagccccacuacaauuggggaacuguaacauugccggaugggucuuaggaaacccagaaugcgaaucauugcucuccaauagaucaugguccuacauugcagaaacaccaaacucugagaaugggacaugcuacccaggggauuucgccgacuaugaggaacugagggagcaauugagcucaguaucaucauucgagagauucgaaauauuccccaaggaaagaucauggcccaaccacacaaccagaggagugacggcagcaugcccccaugcgaggaaaagcaguuuuuacaaaaauuuggucuggcugacggaggcaaauggcucauacccaaaucugagcagguccuaugugaacaaucaagagaaagaaguccuugugcuauggggaguucaucacccgucuaacauagaggaacaaagggcacucuaucggaaagauaaugcuuaugucucuguagugucuucaaauuauaacaggagauucaccccagaaauagcaaaaaggcccaaaguaagagaucaaucagggagaaugaacuauuacuggacuuugcuagaacccggagacacaauaauauuugaggcaacuggaaaucuaauagcaccaugguaugcuuucgcacugaguagaggcccuggaucagggauaaucaccucaaacgcaccacuggaugaaugugacacaaagugucaaacaccccagggagcuauaaacaguagucucccuuuucagaauauacacccugucacaauaggagagugcccaaaauacgucaggaguacgaaauugaggaugguuacaggacuaaggaacaucccauccguucaauccaggggucuguuuggagccauugccgguuucauugaagggggauggacugggaugauggauggaugguaugguuaccaucaucagaacgaacagggaucuggcuaugcugcggaucaaaaaagcacacaaaaugccauuaacgggauuacaaauaaggugaacucuguuaucgagaaaaugaacacucaauucacagcuguggguaaagaauucaacaaauuagaaaaaagaauggaaaacuuaaauaaaaagguugaugauggauuuauggauauuuggacauauaaugcagaauuguugguucuacuggaaaaugaaaggacuuuggauuuucaugacucaaaugugaagaaucuguaugagaaaguaaaaaaccaauuaaggaauaaugcaaaggaacuaggaaauggguguuuugaguucuaccacaagugugacaaugaaugcauggaaaguguaaaaaauggaacuuaugacuacccaaaauauucagaggaaucaaaauuaaacagggaaaagauugauggagugaaauuggaaucaaugggggucuaucggauucuggcgaucuacucaacugucgccaguucacuagugcuucuggucucccugggggcaaucagcuucuggauguguucuaaugggucguuacagugcagaauaugcaucuga

SEQ ID NO: 40604 - RNA, 1701 nt, Artificial Sequence
  hemagglutinin__InfluenzaA__AGO00313
augaagacuaucauugcuuugagcuacauuuucugucagguucucgcccaaaaccuuccaggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaucgaauccuugaugggaaaaacugcacacugauagaugcucuauugggggacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuaucaaugaaggcuucaauuggacuggggucacucagaaugggggaagcuaugcuugcaaaaggggaccugauaacaguuucuucaguagacugaacugguuguacaaaucagaaagcacauauccagugcugaacgugacuaugccaaacaaugacaauuuugacaaacuguacauuuggggaguucaccacccgagcacggacaaagaacaaaccaaccuauauguucaagcaucagggagagucacagucuccaccaagagaagccagcaaacuauaaucccgaaugucgggucuagacccuggguaaggggucugucuaguggaauaagcaucuauuggacaauaguaaaaccgggagacauacuguuaauuaauaguaaugggaaccuaauugcuccucgggguuacuucaaaauacgcacugggaaaagcucaauaaugaggucagaugcacccauuggcaccugcaguucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaaaacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 40605 - RNA, 1704 nt, Artificial Sequence; identical to SEQ ID NO: 39601
  hemagglutinin__InfluenzaA__AGO00325

SEQ ID NO: 40606 - RNA, 1698 nt, Artificial Sequence
  hemagglutinin__InfluenzaA__AGO00337
augaaggcaaaccuacugguccuguuaagugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauguacacccagucacaauaggagagugcccaaaauacgucaggagugccaaauugaggaugguuacaggacuaaggaacacuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40607 - RNA, 1698 nt, Artificial Sequence; identical to SEQ ID NO: 33782
  hemagglutinin__InfluenzaA__AGO00349

SEQ ID NO: 40608 - RNA, 1698 nt, Artificial Sequence
  hemagglutinin__InfluenzaA__AGO00373
augaaggcaaaccuacugguccuguuaugugcacuugcagcugcagaugcagacacaauauguauaggcuaccaugcgaacaacucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccgaccacaacacaaacggaguaacggcagcaugcucccaugaggggaaaagcaguuuuuacagaaauuugcuauggcugacggagaaggagagcucauacccaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaauaugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40609 - RNA, 1698 nt, Artificial Sequence
  hemagglutinin__InfluenzaA__AGO00385
augaaggcaaaccuacugguccuguuaugugcacuugcagcugcagaugcagacacaauauguauaggcuaccaugcgaacaacucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugggaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccgaccacaacacaaacggaguaacggcagcaugcucccaugaggggaaaagcaguuuuuacagaaauuugcuauggcugacggagaaggagagcucauacccaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40610 - RNA, 1698 nt, Artificial Sequence
  hemagglutinin__InfluenzaA__AGO00397
augaaggcaaaccuacugguccuguuaugugcacuugcagcugcagaugcagacacaauauguauaggcuaccaugcgaacaacucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugggaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccgaccacaacacaaacggaguaacggcagcaugcucccaugaggggaaaagcaguuuuuacagaaauuugcuauggcugacggagaaggagagcucauacccaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaaaagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40611 - RNA, 1698 nt, Artificial Sequence
  hemagglutinin__InfluenzaA__AGO00409
augaaggcaaaccuacugguccuguuaugugcacuugcagcugcagaugcagacacaauauguauaggcuaccaugcgaacaacucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugggaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccgaccacaacacaaacggaguaacggcagcaugcucccaugaggggaaaaacaguuuuuacagaaauuugcuauggcugacggagaagaagagcucauacccagagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaaaagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40612 - RNA, 1698 nt, Artificial Sequence
  hemagglutinin__InfluenzaA__AGO00421
augaaggcaaaccuacugguccuguuaugugcacuugcagcugcagaugcagacacaauauguauaggcuaccaugcgaacaacucaaccgacacuguugacacaguacucgagaagaaugugacagugacacacucuguuaaccugcucgaagacagccacaacggaaaacuauguaaauuaaaaggaauagccccacuacaauuggggaaauguaacaucgccggauggcucuugggaaacccaggaugcgacccacugcuuccagugggaucaugguccuacauuguagaaacaccaaacucugagaauggaauauguuauccaggagauuucaucgacuaugaggagcugagggagcaauugagcucagugucaucauucgaaagauucaaaauauuucccaaagaaagcucauggcccgaccacaacacaaccggaguaacggcagcaugcucccaugaggggaaaaacaguuuuuacagaaauuugcuauggcugacgaagaaggagagcucauacccagagcugaaaaauucuuaugugaacaaaaaaaggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaaaaggucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40613 - RNA, 1698 nt, Artificial Sequence
  hemagglutinin__InfluenzaA__AGO00433
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcuggaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40614 - RNA, 1698 nt, Artificial Sequence
  hemagglutinin__InfluenzaA__AGO00445
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaacgcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 40615 - RNA, 1701 nt, Artificial Sequence
  hemagglutinin__InfluenzaA__AGO02696
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggccaaaucaugacucgaacaaagguguaacggcagcauguccucaugcuggagcaaaaggcuucuacaaaaauuuaauauggcuaguuaaaaaaggaaauucauacccaaagcucagcauauccuacauuaaugacaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcuggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugccgcuaguucauugguacugguagucucccugggggcaaucaguuuuuggaugugcucuaaugggucucuacaguguagaauauguauuuaa
